(12) United States Patent
Baker et al.

(10) Patent No.: US 8,067,178 B2
(45) Date of Patent: Nov. 29, 2011

(54) GENE EXPRESSION MARKERS FOR PREDICTION OF PATIENT RESPONSE TO CHEMOTHERAPY

(75) Inventors: Joffre B. Baker, Montara, CA (US); Wayne Cowens, Tiburon, CA (US); Kim Langone, Sunnyvale, CA (US); James Hackett, San Jose, CA (US); Drew Watson, Los Altos, CA (US); Soonmyung Paik, Pittsburgh, PA (US)

(73) Assignees: Genomic Health, Inc., Redwood City, CA (US); NSABP Foundation, Inc., Pittsburgh, PA (US)

( * ) Notice: Subject to any disclaimer, the term of this patent is extended or adjusted under 35 U.S.C. 154(b) by 358 days.

(21) Appl. No.: 12/404,268

(22) Filed: Mar. 13, 2009

(65) Prior Publication Data

US 2009/0305277 A1      Dec. 10, 2009

Related U.S. Application Data

(60) Provisional application No. 61/069,373, filed on Mar. 14, 2008.

(51) Int. Cl.
*C12Q 1/68* (2006.01)
*G01N 33/53* (2006.01)

(52) U.S. Cl. .................. 435/6.14; 435/6.12; 435/7.1

(58) Field of Classification Search .................. None
See application file for complete search history.

(56) References Cited

U.S. PATENT DOCUMENTS

| | | |
|---|---|---|
| 2007/0099209 A1 | 5/2007 | Clarke et al. |
| 2007/0105133 A1 | 5/2007 | Clarke et al. |
| 2009/0258795 A1 | 10/2009 | Cowens et al. |
| 2010/0285980 A1 | 11/2010 | Shak et al. |
| 2010/0291573 A1 | 11/2010 | Cowens et al. |

FOREIGN PATENT DOCUMENTS

| | | |
|---|---|---|
| WO | WO2007082099 | 7/2007 |
| WO | WO2008115419 A3 | 9/2008 |

OTHER PUBLICATIONS

Callagy et al., Bcl-2 is a prognostic marker in breast cancer independently of the Nottingham Prognostic Index. Clin. Cancer Res. 2006; 12(8):2468-75.
Glinsky et al., Microarray analysis identifies a death-from=cancer signature predicting therapy failure in patients with multiple types of cancer. J. Clin. Investigation 2005; 115(6):1503-21.
Miyoshi et al., Association of centrosomal kinase STK15/BTAK mRNA expression with chromosomal instability in human breast cancers. Int. J. Cancer 2001; 92:370-3.
Modlich et al., Predictors of primary breast cancers responsiveness to preoperative Epirubicin/Cyclophosphamide-based chemotherapy: translation of microarray data into clinically useful predictive sianatures. J. Translational Medicine 2005:3:32.
Nakopoulou et al., Stromelysin-3 protein expression in invasive breast cancer: Relation to proliferation, cell survival and patients' outcome. Modern Pathology 2002:15(11):1154-61.
Nessling et al., Candidate genes in breast cancer revealed by microarray-based comparative genomic hybridization of archived tissue. Cancer Res. 2005; 65(2):439-47.
Tanaka et al., Centrosomal kinase AIK1 is overexpressed in invasive ductal carcinoma of the breast. Cancer Research 1999; 59:2041-4.
Urruticoechea et al., Proliferation marker Ki-67 in early breast cancer. J. Clin. Oncology 23:7212-20, (2005).
Valkovic et al., Correlation between vascular endothelial growth factor, angiogenesis, and tumor-associated macrophages in invasive ductal breast carcinoma. Virchows Arch. 2002:440:583-8.
Notterman Daniel et al., "Transcriptional Gene Expression Profiles of Colorectal Adenoma Adenocarcinoma and Normal Tissue Examined by Oligonucleotide Arrays", Cancer Research, 2001, vol. 61, pp. 3124-3130.

*Primary Examiner* — James Martinell
(74) *Attorney, Agent, or Firm* — Carol L. Francis; Bozicevic, Field & Francis LLP

(57) ABSTRACT

The present invention relates to gene sets useful in assessing prognosis and/or predicting the response of cancer, e.g. colorectal cancer to chemotherapy. In addition, the invention relates to a clinically validated cancer test, e.g. colorectal test, for assessment of prognosis and/or prediction of patient response to chemotherapy, using expression analysis. The present invention accommodates the use of archived paraffin embedded biopsy material for assay of all markers in the relevant gene sets and therefore is compatible with the most widely available type of biopsy material.

13 Claims, No Drawings

GENE EXPRESSION MARKERS FOR PREDICTION OF PATIENT RESPONSE TO CHEMOTHERAPY

CROSS-REFERENCE TO RELATED APPLICATION

This application claims priority benefit of U.S. Provisional Application Ser. No. 61/069,373, filed Mar. 14, 2008, the entire disclosure of which is incorporated herein by reference in its entirety.

TECHNICAL FIELD

The present invention provides genes and gene sets, the expression levels of which are useful for predicting response of cancer patients to chemotherapy.

INTRODUCTION

Colorectal cancer is the number two cause of cancer-related death in the United States and the European Union, accounting for 10% of all cancer-related deaths. Although colon cancer and rectal cancer may represent identical or similar disease at the molecular level, surgery for rectal cancer is complicated by anatomical issues. Possibly for this reason, the rate of local recurrence for rectal cancer is significantly higher than for colon cancer, and so the treatment approach is significantly different. Approximately 100,000 colon cancers are newly diagnosed each year in the United States, with about 65% of these being diagnosed as stage II/III as discussed below.

Refining a diagnosis of colorectal cancer involves evaluating the progression status of the cancer using standard classification criteria. Two classification systems have been widely used in colorectal cancer, the modified Duke's (or Astler-Coller) staging system (Stages A-D) (Astler V B, Coller F A., *Ann Surg* 1954; 139:846-52), and more recently TNM staging (Stages I-IV) as developed by the American Joint Committee on Cancer (*AJCC Cancer Staging Manual,* 6th Edition, Springer-Verlag, New York, 2002). Both systems evaluate tumor progression by applying measures of the spread of the primary tumor through layers of colon or rectal wall to adjacent organs, lymph nodes and distant sites. Estimates of recurrence risk and treatment decisions in colon cancer are currently based primarily on tumor stage.

There are approximately 33,000 newly diagnosed Stage II colorectal cancers each year in the United States. Nearly all of these patients are treated by surgical resection of the tumor and, in addition, about 40% are currently treated with chemotherapy based on 5-fluorouracil (5-FU). The decision whether to administer adjuvant chemotherapy is not straightforward. The five-year survival rate for Stage II colon cancer patients treated with surgery alone is approximately 80%. Standard adjuvant treatment with 5-FU+leucovorin (leucovorin-mediated fluorouracil) produces an only 2-4% absolute improvement in 5-year survival in this population. Such treatment also shows significant toxicity, including a rate of toxic death from chemotherapy as high as 1%. Thus, a large number of patients receive toxic therapy from which only a few benefit. A test capable of quantifying likelihood of patient benefit from chemotherapy to more accurately identify Stage II patients for treatment would be extremely useful.

The benefit of chemotherapy in Stage III colon cancer is even more evident than in Stage II. A large proportion of the 31,000 patients annually diagnosed with Stage III colon cancer receive 5-FU-based adjuvant chemotherapy. The absolute benefit of treatment in this setting ranges, depending on the particular regimen employed, from about 18% (5-FU+leucovorin) to about 24% (5-FU+leucovorin+oxaliplatin). Current standard-of-care chemotherapy treatment for Stage III colon cancer patients is moderately effective, achieving an improvement in 5-year survival rate from about 50% (surgery alone) to about 65% (5-FU+leucovorin) or 70% (5-FU+leucovorin+oxaliplatin). Treatment with 5-FU+leucovorin alone or in combination with oxaliplatin is accompanied by a range of adverse side-effects, including toxic death in approximately 1% of patients treated. It has not been established whether a subset of Stage III patients (overall untreated 5-year survival about 50%) exists for which recurrence risk resembles that observed for Stage II patients (overall untreated 5-year survival about 80%).

A test capable of quantifying likelihood of patient benefit from chemotherapy to more accurately identify Stage III patients for treatment would be extremely useful. A patient having a low recurrence risk resembling that of a Stage II patient and a low likelihood of benefit from chemotherapy might elect to forego chemotherapy. A patient with a high recurrence risk and a low likelihood of benefit from 5-FU based chemotherapy might elect an alternative treatment.

Staging of rectal tumors is carried out based on similar criteria as for colon tumor staging, although there are some differences resulting for example from differences in the arrangement of the draining lymph nodes. As a result, Stage II/III rectal tumors bear a reasonable correlation to Stage II/III colon tumors as to their state of progression. As noted above, the rate of local recurrence and other aspects of prognosis differ between rectal cancer and colon cancer, and these differences may arise from difficulties in accomplishing total resection of rectal tumors. Nevertheless, there is no compelling evidence that there is a difference between colon cancer and rectal cancer as to the molecular characteristics of the respective tumors.

Tests able to predict chemotherapy treatment benefit for rectal cancer patients would have utility similar in nature as described for colon cancer tests and the same markers might well have utility in both cancer types. Tests that identify patients more likely to be those that fail to respond to standard-of-care are useful in drug development, for example in identifying patients for inclusion in clinical trials testing the efficacy of alternative drugs. For example, 30-35% of Stage III colon cancer patients fail to survive five years when treated with fluorouracil-based chemotherapy after surgical resection of tumor. Preferential inclusion of these patients in a clinical trial for a new Stage III colon cancer treatment could substantially improve the efficiency and reduce the costs of such a clinical trial.

SUMMARY

The present invention relates to gene sets useful in assessing prognosis and/or predicting the response of cancer, e.g. colorectal cancer to chemotherapy. In addition, the invention relates to a clinically validated cancer test, e.g. colorectal test, for assessment of prognosis and/or prediction of patient response to chemotherapy, using expression analysis. The present invention accommodates the use of archived paraffin embedded biopsy material for assay of all markers in the relevant gene sets and therefore is compatible with the most widely available type of biopsy material.

In one aspect, the present disclosure concerns a method of predicting the likelihood of positive response to treatment with chemotherapy of a subject diagnosed with cancer involving determining the normalized expression level of at least one gene listed in Table 5, or its expression product, in a tumor sample obtained from said subject, and using the normalized expression level to calculate a likelihood of a positive clinical response to chemotherapy, wherein increased normalized expression of one or more of the genes selected from the group consisting of ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2, or their corresponding product, indicates that said subject is predicted to have a decreased likelihood of a positive clinical response to the chemotherapy, and wherein increased normalized expression of one or more of the genes selected from the group consisting of AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, E124, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC, or their corresponding products, indicates that said subject has an increased likelihood of a positive clinical response to chemotherapy.

In another aspect, the present disclosure concerns methods of predicting the likelihood of a positive clinical outcome of treatment with chemotherapy of a subject diagnosed with cancer by determining the normalized expression level of one or more genes listed in Table 5, or their expression products, in a tumor sample obtained from said subject, using the normalized expression level to calculate a likelihood of a positive clinical outcome of treatment with chemotherapy, wherein increased normalized expression of one or more of the genes selected from the group consisting of ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2, or their corresponding products, indicates that said subject is predicted to have a decreased likelihood of a positive clinical outcome, and wherein increased expression of one or more of the genes selected from the group consisting of AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, EI24, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC, or their corresponding products, indicates that said subject has an increased likelihood of a positive clinical outcome.

The clinical outcome of the methods of the present disclosure may be expressed, for example, in terms of Recurrence-Free Interval (RFI), Overall Survival (OS), Disease-Free Survival (DFS), or Distant Recurrence-Free Interval (DRFI).

In one embodiment, the cancer is selected from the group of cancers including colorectal cancer, breast cancer, lung cancer, prostate cancer, hepatocellular cancer, gastric cancer, pancreatic cancer, cervical cancer, ovarian cancer, liver cancer, bladder cancer, cancer of the urinary tract, thyroid cancer, renal cancer, carcinoma, melanoma and brain cancer. In one embodiment the cancer is colorectal cancer. In another embodiment, the colorectal cancer is invasive colorectal cancer or Dukes B (stage II) or Dukes C (stage III) colorectal cancer.

In a particular embodiment, the chemotherapy is adjuvant chemotherapy. In another embodiment, the chemotherapy is neoadjuvant chemotherapy. In a particular embodiment the chemotherapy is 5-fluorouracil with leucovorin. The chemotherapy may further include administration of an additional anti-cancer agent.

In another aspect the present disclosure provides methods of predicting a positive clinical response of a colorectal cancer patient to treatment with 5-fluorouracil involving determining the normalized expression level of one or more of the genes listed in Table 5, or their products, in a tumor sample obtained from said patient, using the normalized expression level to calculate a likelihood of a positive clinical response, wherein increased normalized expression of one or more of the genes selected from the group consisting of ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2, or their corresponding product, indicates a decreased likelihood of clinical response; and increased normalized expression of one or more of the genes selected from the group consisting of AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, E124, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC, or their corresponding product, indicates an increased likelihood of clinical response, and generating a report based on the likelihood of a positive clinical response to chemotherapy.

In another aspect the present disclosure provides methods of predicting an effect of treatment with a 5-fluorouracil (5-FU)-based therapy on duration of a Recurrence-Free Interval (RFI) in a subject diagnosed with colorectal cancer by determining the normalized expression level of one or more of the genes listed in Table 5, or their expression products, in a tumor sample obtained from said subject, using the normalized expression level to calculate a predicted RFI for the subject after treatment with a 5-FU-based therapy, wherein evidence of increased normalized expression of one or more of the genes selected from the group consisting of ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2, or their corresponding product, indicates that said RFI is predicted to be shorter; and evidence of increased normalized expression of one or more of the genes listed elected from the group consisting of AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, E124, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC, or their corresponding product, indicates that said RFI is predicted to be longer.

For all aspects of the method of the present disclosure, determining the expression level of one or more genes may be obtained, for example, by a method of gene expression profiling. The method of gene expression profiling may be, for example, a PCR-based method.

The expression level of said genes can be determined, for example, by RT-PCR (reverse transcriptase PCR) or an other PCR-based method, immunohistochemistry, proteomics techniques, an array-based method, or any other methods known in the art or their combination. In one aspect the RNA transcripts are fragmented.

For all aspects of the methods disclosed herein, the RNA transcript may be detected by assaying for an exon-based sequence or an intron-based sequence, the expression of which correlates with the expression of a corresponding exon sequence.

In an embodiment, the assay for the measurement of said genes, or its expression products, is provided in the form of a kit or kits.

For all aspects of the present disclosure, the expression levels of the genes may be normalized relative to the expression levels of one or more reference genes, or their expression products.

The tumor sample may be e.g. a tissue sample containing cancer cells, or portion(s) of cancer cells, where the tissue can be fixed, paraffin-embedded or fresh or frozen tissue. In a particular embodiment, the tissue is from fine needle, core or other types of biopsy. For example, the tissue sample can be obtained by fine needle aspiration, or by obtaining body fluid containing a cancer cell, e.g. urine, blood, etc.

For all aspects of the present disclosure, the subject preferably is a human patient.

For all aspects of the present disclosure, the methods may further include determining the expression levels of at least two of said genes, or their expression products. It is further contemplated that the method of the present disclosure may further include determining the expression levels of at least three of said genes, or their expression products. It is also contemplated that the method of the present disclosure may further include determining the expression levels of at least four of said genes, or their expression products. It is also contemplated that the method of the present disclosure may further include determining the expression levels of at least five of said genes, or their expression products. The method may involve determination of the expression levels of at least ten (10) or at least fifteen (15) of the transcripts listed above or their products. Thus, for all aspects of the present disclosure, the method may further include determining the expression levels of, e.g., STK15, B1K, or MAD2L1 and at least one other of said genes, or their expression products. Thus, it is further contemplated that the method of the present disclosure may further include determining the expression levels of, e.g., STK15, B1K, or MAD2L1 and at least two others of said genes, or their expression products. Thus, it is also contemplated that the method of the present disclosure may further include determining the expression levels of, e.g., STK15, B1K, or MAD2L1 and at least three others of said genes, or their expression products. Thus, it is also contemplated that the method of the present disclosure may further include determining the expression levels of, e.g., STK15, B1K, or MAD2L1 and at least four others of said genes, or their expression products. Thus, the method may involve determination of the expression levels of, e.g., STK15, B1K, or MAD2L1 and at least nine others totaling ten (10) or at least fourteen others totaling fifteen (15) of the transcripts listed above or their products. It is contemplated that the method will include determining the expression levels of a gene and at least one additional gene that co-expresses with a significant pairwise correlation co-efficient, e.g. a Pearson correlation of $\geq 0.4$.

For all aspects of the methods of the present disclosure, it is contemplated that for every increment of an increase in the level of one or more genes or their expression products, the patient is identified to show an incremental increase in clinical outcome.

For all aspects of the methods of the present disclosure, the determination of expression levels may occur more than one time.

For all aspects of the methods of the present disclosure, the determination of expression levels may occur before the patient is subjected to any therapy following surgical resection.

For all aspects of the methods of the present disclosure, the methods may further include the step of creating a report summarizing said likelihood.

In another aspect the present disclosure provides methods of producing reports that include gene expression information about a tumor sample obtained from a patient that includes the steps of determining information indicative of the expression levels of the genes listed in Table 5, or their expression products, in said tumor sample; and creating a report summarizing said information. In one aspect of the method, if increased expression of AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, E124, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC, or the corresponding expression product, is determined, said report includes a prediction that said subject has an increased likelihood of response to treatment with 5-fluorouracil. In another aspect of the method, if increased expression of one or more of ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2, or the corresponding expression product, is determined, said report includes a prediction that said subject has an decreased likelihood of response to treatment with 5-fluorouracil.

In one aspect the report includes information to support a treatment recommendation for said patient. For example, the information can include a recommendation for adjuvant chemotherapy and/or neoadjuvant chemotherapy, a likelihood of chemotherapy benefit score, or other such data.

In another aspect the present disclosure provides reports for a patient containing a summary of the expression levels of the one or more genes listed in Table 5, or their expression products, in a tumor sample obtained from said patient. In one aspect the report is in electronic form.

In one aspect the report indicates that if increased expression of one or more of ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2, or their corresponding expression products, is determined, said report includes a prediction that said subject has an increased likelihood of cancer recurrence at 10 years.

In another aspect the report indicates that if increased expression of one or more of AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, E124, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC, or their corresponding expression products, is determined, said report includes a prediction that said subject has a decreased likelihood of cancer recurrence at 10 years.

In some embodiments, the report further includes a recommendation for a treatment modality for said patient. In all aspects the report may include a classification of a subject into a risk group. In all aspects a report may include a prediction of the likelihood that said patient will respond positively to treatment with chemotherapy.

In another aspect, the present disclosure concerns methods of preparing a personalized genomics profile for a patient by a) determining the normalized expression levels of at least one gene listed in Table 5, or its expression product, in a tumor sample obtained from said patient; and (b) creating a report summarizing the data obtained by the gene expression analysis.

In another embodiment, the present disclosure provides an array comprising polynucleotides hybridizing to a plurality of the genes listed in Table 5. In another aspect the present disclosure provides arrays having polynucleotides hybridizing to a plurality of the following genes: ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2. In another aspect the present disclosure provides arrays having polynucleotides hybridizing to a plurality of the following genes: AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, E124, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC.

The present disclosure also provides methods for analyzing a colorectal cancer tissue sample to determine whether the sample contains cancer cells likely to respond to a chemotherapy, where the method includes determining a normalized expression value for at least one gene from Table 5, or its expression product, in a colorectal cancer tissue sample obtained from the patient; inputting the normalized expression value of the least one gene from Table 5, or a gene co-expressed with a gene of Table 5, into a computer programmed to execute an algorithm to convert the value to a score indicative of a likelihood of the patient to respond to chemotherapy, wherein expression of one or more of the genes selected from the group consisting of AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, E124, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC, or a gene co-expressed with one or more of said genes, is positively correlated with an increased likelihood of a positive clinical response to treatment with chemotherapy; and expression of one or more of the genes selected from the group consisting of ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2, or a gene co-expressed with one or more of said genes, is negatively correlated with an increased likelihood of a positive response to treatment with chemotherapy; and generating a report comprising the score.

In related embodiments, the tumor sample is obtained from a solid tumor, e.g., a colorectal cancer. In further related embodiments, the chemotherapy is a 5-fluorouracil (5-FU)-based treatment.

DETAILED DESCRIPTION OF THE EXEMPLARY EMBODIMENTS

Definitions

Unless defined otherwise, technical and scientific terms used herein have the same meaning as commonly understood by one of ordinary skill in the art to which this invention belongs. Singleton et al., Dictionary of Microbiology and Molecular Biology 2nd ed., J. Wiley & Sons (New York, N.Y. 1994), and March, Advanced Organic Chemistry Reactions, Mechanisms and Structure 4th ed., John Wiley & Sons (New York, N.Y. 1992), provide one skilled in the art with a general guide to many of the terms used in the present application.

One skilled in the art will recognize many methods and materials similar or equivalent to those described herein, which could be used in the practice of the present invention. Indeed, the present invention is in no way limited to the methods and materials described. For purposes of the present invention, the following terms are defined below.

The term "tumor," as used herein, refers to any neoplastic cell growth and proliferation, whether malignant or benign, and all pre-cancerous and cancerous cells and tissues.

The terms "cancer" and "cancerous" refer to or describe the physiological condition in mammals that is typically characterized by unregulated cell growth. Examples of cancer include, but are not limited to, colorectal cancer, breast cancer, ovarian cancer, lung cancer, prostate cancer, hepatocellular cancer, gastric cancer, pancreatic cancer, cervical cancer, liver cancer, bladder cancer, cancer of the urinary tract, thyroid cancer, renal cancer, carcinoma, melanoma, and brain cancer. In one embodiment the cancer is colorectal cancer. In another embodiment the cancer is invasive colorectal cancer or Dukes B (stage II) or Dukes C (stage III) colorectal cancer.

The "pathology" of cancer includes all phenomena that compromise the well-being of the patient. This includes, without limitation, abnormal or uncontrollable cell growth, metastasis, interference with the normal functioning of neighboring cells, release of cytokines or other secretory products at abnormal levels, suppression or aggravation of inflammatory or immunological response, neoplasia, premalignancy, malignancy, invasion of surrounding or distant tissues or organs, such as lymph nodes, etc.

The term "colorectal cancer" is used in the broadest sense and refers to (1) all stages and all forms of cancer arising from epithelial cells of the large intestine and/or rectum and/or (2) all stages and all forms of cancer affecting the lining of the large intestine and/or rectum. In the staging systems used for classification of colorectal cancer, the colon and rectum are treated as one organ.

According to the tumor, node, metastatis (TNM) staging system of the American Joint Committee on Cancer (AJCC) (Greene et al. (eds.), AJCC Cancer Staging Manual. 6th Ed. New York, N.Y.: Springer; 2002), the various stages of colorectal cancer are defined as follows:

Tumor: T1: tumor invades submucosa; T2: tumor invades muscularis propria; T3: tumor invades through the muscularis propria into the subserose, or into the pericolic or perirectal tissues; T4: tumor directly invades other organs or structures, and/or perforates.

Node: N0: no regional lymph node metastasis; N1: metastasis in 1 to 3 regional lymph nodes; N2: metastasis in 4 or more regional lymph nodes.

Metastasis: M0: mp distant metastasis; M1: distant metastasis present.

Stage groupings: Stage I: T1 N0 M0; T2 N0 M0; Stage II: T3 N0 M0; T4 N0 M0; Stage III: any T, N1-2; M0; Stage IV: any T, any N, M1.

According to the Modified Duke Staging System, the various stages of colorectal cancer are defined as follows:

Stage A: the tumor penetrates into the mucosa of the bowel wall but not further. Stage B: tumor penetrates into and through the muscularis propria of the bowel wall; Stage C: tumor penetrates into but not through muscularis propria of the bowel wall, there is pathologic evidence of colorectal cancer in the lymph nodes; or tumor penetrates into and through the muscularis propria of the bowel wall, there is pathologic evidence of cancer in the lymph nodes; Stage D: tumor has spread beyond the confines of the lymph nodes, into other organs, such as the liver, lung or bone.

Prognostic factors are those variables related to the natural history of colorectal cancer, which influence the recurrence rates and outcome of patients once they have developed colorectal cancer. Clinical parameters that have been associated with a worse prognosis include, for example, lymph node involvement, and high grade tumors. Prognostic factors are frequently used to categorize patients into subgroups with different baseline relapse risks.

The term "prognosis" is used herein to refer to the prediction of the likelihood of cancer-attributable death or progression, including recurrence, metastatic spread, and drug resistance, of a neoplastic disease, such as colon cancer. "Prognosis" thus encompasses prediction of response to chemotherapy.

The term "prediction" is used herein to refer to the likelihood that a patient will have a particular clinical outcome, whether positive or negative, following treatment with chemotherapy and, optionally, surgical removal of the primary tumor. The predictive methods of the present disclosure can be used clinically to make treatment decisions by choosing the most appropriate treatment modalities for any particular patient. The predictive methods of the present disclosure are valuable tools in predicting if a patient is likely to respond favorably to a treatment regimen, such as chemotherapy, surgical intervention, or both.

The term "positive clinical response" can be assessed using any endpoint indicating a benefit to the patient, including, without limitation, (1) inhibition, to some extent, of tumor growth, including slowing down and complete growth arrest; (2) reduction in the number of tumor cells; (3) reduction in tumor size; (4) inhibition (i.e., reduction, slowing down or complete stopping) of tumor cell infiltration into adjacent peripheral organs and/or tissues; (5) inhibition of metastasis; (6) enhancement of anti-tumor immune response, possibly resulting in regression or rejection of the tumor; (7) relief, to some extent, of one or more symptoms associated with the tumor; (8) increase in the length of survival following treatment; and/or (9) decreased mortality at a given point of time following treatment. Positive clinical response may also be expressed in terms of various measures of clinical outcome. Positive clinical outcome can also be considered in the context of an individual's outcome relative to an outcome of a population of patients having a comparable clinical diagnosis, and can be assessed using various endpoints such as an increase in the duration of Recurrence-Free interval (RFI), an increase in the time of survival as compared to Overall Survival (OS) in a population, an increase in the time of Disease-Free Survival (DFS), an increase in the duration of Distant Recurrence-Free Interval (DRFI), and the like. An increase in the likelihood of positive clinical response corresponds to a decrease in the likelihood of cancer recurrence.

The term "long-term" survival is used herein to refer to survival for at least 3 years, or for at least 5 years.

The term "Recurrence-Free Interval (RFI)" is used herein to refer to time in years to first colon cancer recurrence. RFI excludes the identification of a second primary cancer or death without evidence of recurrence.

The term "Overall Survival (OS)" is used herein to refer to time in years from surgery to death from any cause.

The term "Disease-Free Survival (DFS)" is used herein to refer to the length of time (in years) after treatment for colon cancer during which a patient survives with no sign of recurrence.

The term "Distant Recurrence-Free Interval (DRFI)" is used herein to refer to the time (in years) from surgery to the first cancer recurrence that is regionally distant from the primary tumor.

The term "microarray" refers to an ordered arrangement of hybridizable array elements, preferably polynucleotide probes, on a substrate.

The term "polynucleotide," when used in singular or plural, generally refers to any polyribonucleotide or polydeoxyribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. The term "polynucleotide" specifically includes cDNAs. The term includes DNAs (including cDNAs) and RNAs that contain one or more modified bases. Thus, DNAs or RNAs with backbones modified for stability or for other reasons are "polynucleotides" as that term is intended herein. Moreover, DNAs or RNAs comprising unusual bases, such as inosine, or modified bases, such as tritiated bases, are included within the term "polynucleotides" as defined herein. In general, the term "polynucleotide" embraces all chemically, enzymatically and/or metabolically modified forms of unmodified polynucleotides, as well as the chemical forms of DNA and RNA characteristic of viruses and cells, including simple and complex cells.

The term "oligonucleotide" refers to a relatively short polynucleotide, including, without limitation, single-stranded deoxyribonucleotides, single- or double-stranded ribonucleotides, RNA:DNA hybrids and double-stranded DNAs. Oligonucleotides, such as single-stranded DNA probe oligonucleotides, are often synthesized by chemical methods, for example using automated oligonucleotide synthesizers that are commercially available. However, oligonucleotides can be made by a variety of other methods, including in vitro recombinant DNA-mediated techniques and by expression of DNAs in cells and organisms.

The terms "differentially expressed gene," "differential gene expression" and their synonyms, which are used interchangeably, refer to a gene whose expression is activated to a higher or lower level in a subject suffering from a disease, specifically cancer, such as colon cancer, relative to its expression in a normal or control subject. The terms also include genes whose expression is activated to a higher or lower level at different stages of the same disease. It is also understood that a differentially expressed gene may be either activated or inhibited at the nucleic acid level or protein level, or may be subject to alternative splicing to result in a different polypeptide product. Such differences may be evidenced by a change in mRNA levels, surface expression, secretion or other partitioning of a polypeptide, for example. Differential expression includes both quantitative, as well as qualitative, differences in the temporal or cellular expression pattern in a gene, for example, normal and diseased cells, or among cells which have undergone different disease events or disease stages.

The term "increased expression" or "increased normalized expression" with regard to a gene or an RNA transcript or other expression product (e.g., protein) is used to refer to the level of the transcript (or fragmented RNA) determined by normalization to the level of reference mRNAs, which might be all measured transcripts in the specimen or a particular reference set of mRNAs. A gene exhibits "increased expression" in a subpopulation of subjects when the normalized expression level of an RNA transcript (or its gene product) is higher in one clinically relevant subpopulation of patients (e.g., patients who are responsive to chemotherapy treatment) than in a related subpopulation (e.g., patients who are not responsive to said chemotherapy). In the context of an analysis of a normalized expression level of a gene in tissue obtained from an individual subject, a gene is exhibits "increased expression" when the normalized expression level of the gene trends toward or more closely approximates the normalized expression level characteristic of such a clinically relevant subpopulation of patients. Thus, for example, when the gene analyzed is a gene that shows increased expression in responsive subjects as compared to non-responsive subjects, then if the expression level of the gene in the patient sample trends toward a level of expression characteristic of a responsive subject, then the gene expression level supports a determination that the individual patient is likely to be a responder. Similarly, where the gene analyzed is a gene that is increased in expression in non-responsive patients as compared to responsive patients, then if the expression level of the gene in the patient sample trends toward a level of expression characteristic of a non-responsive subject, then the gene expression level supports a determination that the individual patient will be nonresponsive Thus normalized expression of a given gene as disclosed herein can be described as being positively correlated with an increased likelihood of positive clinical response to chemotherapy or as being positively correlated with a decreased likelihood of a positive clinical response to chemotherapy.

The phrase "gene amplification" refers to a process by which multiple copies of a gene or gene fragment are formed in a particular cell or cell line. The duplicated region (a stretch of amplified DNA) is often referred to as "amplicon." Usually, the amount of the messenger RNA (mRNA) produced, i.e., the level of gene expression, also increases in the proportion of the number of copies made of the particular gene expressed.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, typically: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., with washes at 42° C. in 0.2×SSC (sodium chloride/sodium citrate) and 50% formamide, followed by a high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

In the context of the present disclosure, reference to "at least one," "at least two," "at least five," etc. of the genes listed in any particular gene set means any one or any and all combinations of the genes listed.

The term "node negative" cancer, such as "node negative" colon cancer, is used herein to refer to cancer that has not spread to the lymph nodes.

The terms "splicing" and "RNA splicing" are used interchangeably and refer to RNA processing that removes introns and joins exons to produce mature mRNA with continuous coding sequence that moves into the cytoplasm of an eukaryotic cell.

In theory, the term "exon" refers to any segment of an interrupted gene that is represented in the mature RNA product (B. Lewin. *Genes IV* Cell Press, Cambridge Mass. 1990). In theory the term "intron" refers to any segment of DNA that is transcribed but removed from within the transcript by splicing together the exons on either side of it. Operationally, exon sequences occur in the mRNA sequence of a gene as defined by Ref. SEQ ID numbers. Operationally, intron sequences are the intervening sequences within the genomic DNA of a gene, bracketed by exon sequences and having GT and AG splice consensus sequences at their 5' and 3' boundaries.

The term "expression cluster" is used herein to refer to a group of genes which co-express, e.g., tend to exhibit a similar change in expression level across different samples, when studied within samples from a defined set of patients. As used herein, the genes within an expression cluster show similar expression patterns when studied within samples from patients with Stage II and/or Stage III cancers of the colon and/or rectum.

Reference to markers for prediction of response to 5-fluorouracil (5-FU) and like expressions encompass within their meaning response to treatment comprising 5-FU as monotherapy, or in combination with other agents, or as prodrugs, or together with local therapies such as surgery and radiation, or as adjuvant or neoadjuvant chemotherapy, or as part of a multimodal approach to the treatment of neoplastic disease. The general mechanism of action of 5-FU is its activity as a pyrimidine antimetabolite. In 5-FU, the smaller fluorine at position 5 allows the molecule to mimic uracil biochemically. However, the fluorine-carbon bond is much tighter than that of C-H and prevents methylation of the 5 position of 5-FU by thymidylate synthase. Instead, in the presence of the physiological cofactor 5,10-methylene tetrahydrofolate, the fluoropyrimidine locks the enzyme in an inhibited state and prevents the synthesis of thymidylate, a required DNA precursor.

A 5-FU combination or 5-FU combination therapy refers to a combination of 5-FU and another agent. A number of agents have been combined with 5-FU to enhance the cytotoxic activity through biochemical modulation. Addition of exogenous folate in the form of 5-formyl-tetrahydrofolate (leucovorin) sustains inhibition of thymidylate synthase. Methotrexate, by inhibiting purine synthesis and increasing cellular pools of certain substrates for reactivity with 5-FU, enhances the activation of 5-FU. The combination of cisplatin and 5-FU increases the antitumor activity of 5-FU. Oxaliplatin is commonly used with 5-FU and leucovorin for treating colorectal cancer, and it may inhibit catabolism of 5-FU, perhaps by inhibiting dihydropyrimidine dehydrogenase (the enzyme that is responsible for the catabolism of 5-FU), and may also inhibit expression of thymidylate synthase. The combination of 5-FU and irinotecan, a topoisomerase-1 inhibitor, is a treatment that combines 5-FU with an agent that has a different mechanism of action. Eniluracil, which is an inactivator of dihydropyrimidine dehydrogenase, leads to another strategy for improving the efficacy of 5-FU.

A number of 5-FU prodrugs have been developed. One is capecitabine (N4-pentoxycarbonyl-5'-deoxy-5-fluorcytidine). This orally administered agent is converted to 5'-deoxy-5-fluorcytidine by the ubiquitous enzyme cytidine deaminase. The final step in its activation occurs when thymidine phosphorylase cleaves off the 5'-deoxy sugar, leaving intracellular 5-FU. Capecitabine (Xeloda®) is approved by the FDA for certain treatments including colorectal cancer. Another fluoropyrimidine that acts as a prodrug for 5-FU is ftorafur.

As used herein, the terms "5-FU-based therapy", "5-FU based treatment", and "5-FU therapy" are used interchangeably to refer to encompass administration of 5-FU or a prodrug thereof and further encompasses administion of 5-FU combination or 5-FU combination therapy (e.g., 5-FU with the agents exemplified above).

General Description

The practice of the methods and compositions of the present disclosure will employ, unless otherwise indicated, conventional techniques of molecular biology (including recombinant techniques), microbiology, cell biology, and biochemistry, which are within the skill of the art. Such techniques are explained fully in the literature, such as, "Molecular Cloning: A Laboratory Manual", $2^{nd}$ edition (Sambrook et al., 1989); "Oligonucleotide Synthesis" (M. J. Gait, ed., 1984); "Animal Cell Culture" (R. I. Freshney, ed., 1987); "Methods in Enzymology" (Academic Press, Inc.); "Handbook of Experimental Immunology", $4^{th}$ edition (D. M. Weir & C. C. Blackwell, eds., Blackwell Science Inc., 1987); "Gene Transfer Vectors for Mammalian Cells" (J. M. Miller & M. P. Calos, eds., 1987); "Current Protocols in Molecular Biology" (F. M. Ausubel et al., eds., 1987); and "PCR: The Polymerase Chain Reaction", (Mullis et al., eds., 1994).

Based on evidence of differential expression of a gene (e.g., as detected by assaying for an RNA transcript or expression product thereof) in cancer cells that positively respond to chemotherapy and non-responsive cancer cells, the present disclosure provides prognostic and/or predictive gene markers for colorectal cancer. Thus, in a particular aspect, the present disclosure provides prognostic and/or predictive gene markers of Stage II and/or Stage III colorectal cancer. The prognostic and/or predictive markers and associated information provided by the present disclosure allow physicians to make more intelligent treatment decisions, and to customize the treatment of colorectal cancer to the needs of individual patients, thereby maximizing the benefit of treatment and minimizing the exposure of patients to unnecessary treatments, which do not provide any significant benefits and often carry serious risks due to toxic side-effects.

The prognostic and/or predictive markers and associated information provided by the present disclosure predicting the clinical outcome in Stage II and/or Stage III cancers of the colon and/or rectum has utility in the development of drugs to treat Stage II and/or Stage III cancers of the colon and/or rectum.

The prognostic and/or predictive markers and associated information provided by the present disclosure predicting the clinical outcome of treatment with 5-FU/leucovorin of Stage II and/or Stage III cancers of the colon and/or rectum also have utility in screening patients for inclusion in clinical trials that test the efficacy of other drug compounds. The predictive markers and associated information provided by the present disclosure predicting the clinical outcome of treatment with 5-FU/leucovorin of Stage II and/or Stage III cancers of the colon and/or rectum are useful as inclusion criterion for a clinical trial. For example, a patient is more likely to be included in a clinical trial if the results of the test indicate that the patient will have a poor clinical outcome if treated with surgery and 5-FU/leucovorin and a patient is less likely to be included in a clinical trial if the results of the test indicate that the patient will have a good clinical outcome if treated with surgery alone or with surgery and 5-FU/leucovorin.

In a particular embodiment, prognostic and/or predictive markers and associated information are used to design or produce a reagent that modulates the level or activity of the gene's transcript (i.e., RNA transcript) or its expression product. Said reagents may include but are not limited to an antisense RNA, a small inhibitory RNA, a ribozyme, a monoclonal or polyclonal antibody.

In various embodiments of the methods of the present disclosure, various technological approaches are available for determination of expression levels of the disclosed genes, including, without limitation, RT-PCR, microarrays, serial analysis of gene expression (SAGE) and Gene Expression Analysis by Massively Parallel Signature Sequencing (MPSS), which will be discussed in detail below. In particular embodiments, the expression level of each gene may be determined in relation to various features of the expression products of the gene including exons, introns, protein epitopes and protein activity Gene Expression Profiling Methods of gene expression profiling include methods based on hybridization analysis of polynucleotides, methods based on sequencing of polynucleotides, and proteomics-based methods. The most commonly used methods known in the art for the quantification of mRNA expression in a sample include northern blotting and in situ hybridization (Parker & Barnes, Methods in Molecular Biology 106:247-283 (1999)); RNAse protection assays (Hod, Biotechniques 13:852-854 (1992)); and PCR-based methods, such as reverse transcription polymerase chain reaction (RT-PCR) (Weis et al., Trends in Genetics 8:263-264 (1992)). Alternatively, antibodies may be employed that can recognize sequence-specific duplexes, including DNA duplexes, RNA duplexes, and DNA-RNA hybrid duplexes or DNA-protein duplexes. Representative methods for sequencing-based gene expression analysis include Serial Analysis of Gene Expression (SAGE), and gene expression analysis by massively parallel signature sequencing (MPSS).

Reverse Transcriptase PCR (RT-PCR)

The first step is the isolation of mRNA from a target sample. The starting material is typically total RNA isolated from human tumors or tumor cell lines, and, optionally, corresponding normal tissues or cell lines as a control, respectively. If the source of mRNA is a primary tumor, mRNA can be extracted, for example, from frozen or archived paraffin-embedded and fixed (e.g. formalin-fixed) tissue samples.

General methods for mRNA extraction are well known in the art and are disclosed in standard textbooks of molecular biology, including Ausubel et al., *Current Protocols of Molecular Biology*, John Wiley and Sons (1997). Methods for RNA extraction from paraffin embedded tissues are disclosed, for example, in Rupp and Locker, *Lab Invest.* 56:A67 (1987), and De Andres et al., *BioTechniques* 18:42044 (1995). In particular, RNA isolation can be performed using a purification kit, buffer set and protease from commercial manufacturers, such as Qiagen, according to the manufacturer's instructions. For example, total RNA from cells in culture can be isolated using Qiagen RNeasy mini-columns. Other commercially available RNA isolation kits include Master-Pure™ Complete DNA and RNA Purification Kit (EPICENTRE®, Madison, Wis.), and Paraffin Block RNA Isolation Kit (Ambion, Inc.). Total RNA from tissue samples can be isolated using RNA Stat-60 (Tel-Test). RNA prepared from tumor can be isolated, for example, by cesium chloride density gradient centrifugation.

As RNA cannot serve as a template for PCR, the first step in gene expression profiling by RT-PCR is the reverse transcription of the RNA template into cDNA, followed by its exponential amplification in a PCR reaction. The two most commonly used reverse transcriptases are avilo myeloblastosis virus reverse transcriptase (AMV-RT) and Moloney murine leukemia virus reverse transcriptase (MMLV-RT). The reverse transcription step is typically primed using specific primers, random hexamers, or oligo-dT primers, depending on the circumstances and the goal of expression profiling. For example, extracted RNA can be reverse-transcribed using a GeneAmp RNA PCR kit (Perkin Elmer, CA, USA), following the manufacturer's instructions. The derived cDNA can then be used as a template in the subsequent PCR reaction.

Although the PCR step can use a variety of thermostable DNA-dependent DNA polymerases, it typically employs the Taq DNA polymerase, which has a 5'-3' nuclease activity but lacks a 3'-5' proofreading endonuclease activity. Thus, TaqMan® PCR typically utilizes the 5'-nuclease activity of Taq or Tth polymerase to hydrolyze a hybridization probe bound to its target amplicon, but any enzyme with equivalent 5' nuclease activity can be used. Two oligonucleotide primers are used to generate an amplicon typical of a PCR reaction. A third oligonucleotide, or probe, is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

TaqMan® RT-PCR can be performed using commercially available equipment, such as, for example, ABI PRISM 7700™ Sequence Detection System™ (Perkin-Elmer-Applied Biosystems, Foster City, Calif., USA), or Lightcycler (Roche Molecular Biochemicals, Mannheim, Germany). In a preferred embodiment, the 5' nuclease procedure is run on a real-time quantitative PCR device such as the ABI PRISM 7700™ Sequence Detection System™. The system consists of a thermocycler, laser, charge-coupled device (CCD), camera and computer. The system amplifies samples in a 96-well format on a thermocycler. During amplification, laser-induced fluorescent signal is collected in real-time through fiber optics cables for all 96 wells, and detected at the CCD. The system includes software for running the instrument and for analyzing the data.

5'-Nuclease assay data are initially expressed as $C_t$, or the threshold cycle. As discussed above, fluorescence values are recorded during every cycle and represent the amount of product amplified to that point in the amplification reaction. The point when the fluorescent signal is first recorded as statistically significant is the threshold cycle ($C_t$).

To minimize errors and the effect of sample-to-sample variation, RT-PCR is usually performed using an internal standard. The ideal internal standard is expressed at a constant level among different tissues, and is unaffected by the experimental treatment. RNAs most frequently used to normalize patterns of gene expression are mRNAs for the housekeeping genes glyceraldehyde-3-phosphate-dehydrogenase (GAPDH) and P-actin.

A more recent variation of the RT-PCR technique is the real time quantitative PCR, which measures PCR product accumulation through a dual-labeled fluorigenic probe (i.e., TaqMan® probe). Real time PCR is compatible both with quantitative competitive PCR, where internal competitor for each target sequence is used for normalization, and with quantitative comparative PCR using a normalization gene contained within the sample, or a housekeeping gene for RT-PCR. For further details see, e.g. Held et al., *Genome Research* 6:986-994 (1996).

The steps of a representative protocol for profiling gene expression using fixed, paraffin-embedded tissues as the RNA source, including mRNA isolation, purification, primer extension and amplification are given in various published journal articles (for example: T. E. Godfrey et al. J. Molec. Diagnostics 2: 84-91 (2000); K. Specht et al., Am. J. Pathol. 158: 419-29 (2001)). Briefly, a representative process starts with cutting about 10 µm thick sections of paraffin-embedded tumor tissue samples. The RNA is then extracted, and protein and DNA are removed. After analysis of the RNA concentration, RNA repair and/or amplification steps may be included, if necessary, and RNA is reverse transcribed using gene specific primers followed by RT-PCR.

MassARRAY System

In the MassARRAY-based gene expression profiling method, developed by Sequenom, Inc. (San Diego, Calif.) following the isolation of RNA and reverse transcription, the obtained cDNA is spiked with a synthetic DNA molecule (competitor), which matches the targeted cDNA region in all positions, except a single base, and serves as an internal standard. The cDNA/competitor mixture is PCR amplified and is subjected to a post-PCR shrimp alkaline phosphatase (SAP) enzyme treatment, which results in the dephosphorylation of the remaining nucleotides. After inactivation of the alkaline phosphatase, the PCR products from the competitor and cDNA are subjected to primer extension, which generates distinct mass signals for the competitor- and cDNA-derived PCR products. After purification, these products are dispensed on a chip array, which is pre-loaded with components needed for analysis with matrix-assisted laser desorption ionization time-of-flight mass spectrometry (MALDI-TOF MS) analysis. The cDNA present in the reaction is then quantified by analyzing the ratios of the peak areas in the mass spectrum generated. For further details see, e.g. Ding and Cantor, Proc. Natl. Acad. Sci. USA 100:3059-3064 (2003).

Other PCR-based Methods

Further PCR-based techniques include, for example, differential display (Liang and Pardee, Science 257:967-971 (1992)); amplified fragment length polymorphism (iAFLP) (Kawamoto et al., Genome Res. 12:1305-1312 (1999)); BeadArray™ technology (Illumina, San Diego, Calif.; Oliphant et al., Discovery of Markers for Disease (Supplement to Biotechniques), June 2002; Ferguson et al., Analytical Chemistry 72:5618 (2000)); BeadsArray for Detection of Gene Expression (BADGE), using the commercially available Luminex100 LabMAP system and multiple color-coded microspheres (Luminex Corp., Austin, Tex.) in a rapid assay for gene expression (Yang et al., Genome Res. 11:1888-1898 (2001)); and high coverage expression profiling (HiCEP) analysis (Fukumura et al., Nucl. Acids. Res. 31(16) e94 (2003)).

Microarrays

Differential gene expression can also be identified, or confirmed using the microarray technique. Thus, the expression profile of colorectal cancer-associated genes can be measured in either fresh or paraffin-embedded tumor tissue, using microarray technology. In this method, polynucleotide sequences of interest (including cDNAs and oligonucleotides) are plated, or arrayed, on a microchip substrate. The arrayed sequences are then hybridized with specific DNA probes from cells or tissues of interest. Just as in the RT-PCR method, the source of mRNA typically is total RNA isolated from human tumors or tumor cell lines, and corresponding normal tissues or cell lines. Thus RNA can be isolated from a variety of primary tumors or tumor cell lines. If the source of mRNA is a primary tumor, mRNA can be extracted, for example, from frozen or archived paraffin-embedded and fixed (e.g. formalin-fixed) tissue samples, which are routinely prepared and preserved in everyday clinical practice.

In a specific embodiment of the microarray technique, PCR amplified inserts of cDNA clones are applied to a substrate in a dense array. Preferably at least 10,000 nucleotide sequences are applied to the substrate. The microarrayed genes, immobilized on the microchip at 10,000 elements each, are suitable for hybridization under stringent conditions. Fluorescently labeled cDNA probes may be generated through incorporation of fluorescent nucleotides by reverse transcription of RNA extracted from tissues of interest. Labeled cDNA probes applied to the chip hybridize with specificity to each spot of DNA on the array. After stringent washing to remove non-specifically bound probes, the chip is scanned by confocal laser microscopy or by another detection method, such as a CCD camera. Quantitation of hybridization of each arrayed element allows for assessment of corresponding mRNA abundance. With dual color fluorescence, separately labeled cDNA probes generated from two sources of RNA are hybridized pair wise to the array. The relative abundance of the transcripts from the two sources corresponding to each specified gene is thus determined simultaneously. The miniaturized scale of the hybridization affords a convenient and rapid evaluation of the expression pattern for large numbers of genes. Such methods have been shown to have the sensitivity required to detect rare transcripts, which are expressed at a few copies per cell, and to reproducibly detect at least approximately two-fold differences in the expression levels (Schena et al., *Proc. Natl. Acad. Sci. USA* 93(2):106-149 (1996)). Microarray analysis can be performed by commercially available equipment, following manufacturer's protocols, such as by using the Affymetrix GenChip technology, or Incyte's microarray technology.

The development of microarray methods for large-scale analysis of gene expression makes it possible to search systematically for molecular markers of outcome predictions for a variety of chemotherapy treatments for a variety of tumor types.

Serial Analysis of Gene Expression (SAGE)

Serial analysis of gene expression (SAGE) is a method that allows the simultaneous and quantitative analysis of a large number of gene transcripts, without the need of providing an individual hybridization probe for each transcript. First, a short sequence tag (about 10-14 bp) is generated that contains sufficient information to uniquely identify a transcript, provided that the tag is obtained from a unique position within each transcript. Then, many transcripts are linked together to form long serial molecules, that can be sequenced, revealing the identity of the multiple tags simultaneously. The expression pattern of any population of transcripts can be quantitatively evaluated by determining the abundance of individual tags, and identifying the gene corresponding to each tag. For more details see, e.g. Velculescu et al., *Science* 270:484-487 (1995); and Velculescu et al., *Cell* 88:243-51 (1997).

Gene Expression Analysis by Massively Parallel Signature Sequencing (MPSS)

This method, described by Brenner et al., *Nature Biotechnology* 18:630-634 (2000), is a sequencing approach that combines non-gel-based signature sequencing with in vitro cloning of millions of templates on separate 5 μm diameter microbeads. First, a microbead library of DNA templates is constructed by in vitro cloning. This is followed by the assembly of a planar array of the template-containing microbeads in a flow cell at a high density (typically greater than $3\times10^6$ microbeads/cm$^2$). The free ends of the cloned templates on each microbead are analyzed simultaneously, using a fluorescence-based signature sequencing method that does not require DNA fragment separation. This method has been shown to simultaneously and accurately provide, in a single operation, hundreds of thousands of gene signature sequences from a yeast cDNA library.

Immunohistochemistry

Immunohistochemistry methods are also suitable for detecting the expression levels of the prognostic and/or predictive markers of the present disclosure. Thus, antibodies or antisera, preferably polyclonal antisera, and most preferably monoclonal antibodies specific for each marker are used to detect expression. The antibodies can be detected by direct labeling of the antibodies themselves, for example, with radioactive labels, fluorescent labels, hapten labels such as, biotin, or an enzyme such as horse radish peroxidase or alkaline phosphatase. Alternatively, unlabeled primary antibody is used in conjunction with a labeled secondary antibody, comprising antisera, polyclonal antisera or a monoclonal antibody specific for the primary antibody. Immunohistochemistry protocols and kits are well known in the art and are commercially available.

Proteomics

The term "proteome" is defined as the totality of the proteins present in a sample (e.g. tissue, organism, or cell culture) at a certain point of time. Proteomics includes, among other things, study of the global changes of protein expression in a sample (also referred to as "expression proteomics"). Proteomics typically includes the following steps: (1) separation of individual proteins in a sample by 2-D gel electrophoresis (2-D PAGE); (2) identification of the individual proteins recovered from the gel, e.g. by mass spectrometry or N-terminal sequencing, and (3) analysis of the data using bioinformatics. Proteomics methods are valuable supplements to other methods of gene expression profiling, and can be used, alone or in combination with other methods, to detect the products of the prognostic and/or predictive markers of the present disclosure.

Promoter Methylation Analysis

A number of methods for quantization of RNA transcripts (gene expression analysis) or their protein translation products are discussed herein. The expression level of genes may also be inferred from information regarding chromatin structure, such as for example the methylation status of gene promoters and other regulatory elements and the acetylation status of histones.

In particular, the methylation status of a promoter influences the level of expression of the gene regulated by that promoter. Aberrant methylation of particular gene promoters has been implicated in expression regulation, such as for example silencing of tumor suppressor genes. Thus, examination of the methylation status of a gene's promoter can be utilized as a surrogate for direct quantization of RNA levels.

Several approaches for measuring the methylation status of particular DNA elements have been devised, including methylation-specific PCR (Herman J. G. et al. (1996) Methylation-specific PCR: a novel PCR assay for methylation status of CpG islands. Proc. Natl Acad. Sci. USA. 93, 9821-9826.) and bisulfite DNA sequencing (Frommer M. et al. (1992) A genomic sequencing protocol that yields a positive display of 5-methylcytosine residues in individual DNA strands. Proc. Natl Acad. Sci. USA. 89, 1827-1831.). More recently, microarray-based technologies have been used to characterize promoter methylation status (Chen C. M. (2003) Methylation target array for rapid analysis of CpG island hypermethylation in multiple tissue genomes. Am. J. Pathol. 163, 37-45.).

General Description of the mRNA Isolation, Purification and Amplification

The steps of a representative protocol for profiling gene expression using fixed, paraffin-embedded tissues as the RNA source, including mRNA isolation, purification, primer extension and amplification are provided in various published journal articles (for example: T. E. Godfrey et al., *J. Molec. Diagnostics* 2: 84-91 (2000); K. Specht et al., *Am. J. Pathol.* 158: 419-29 (2001)). Briefly, a representative process starts with cutting about 10 μm thick sections of paraffin-embedded tumor tissue samples. The RNA is then extracted, and protein and DNA are removed. After analysis of the RNA concentration, RNA repair and/or amplification steps may be included, if necessary, and the RNA is reverse transcribed using gene specific primers followed by RT-PCR. Finally, the data are analyzed to identify and/or facilitate selection of treatment option(s) available to the patient on the basis of the characteristic gene expression pattern identified in the tumor sample examined, dependent on the predicted likelihood of response of the cancer to treatment.

Colon Cancer Gene Set, Assayed Gene Subsequences, and Clinical Application of Gene Expression Data The measured expression of certain genes by colon cancer tissue to provide prognostic and/or predictive information which is indicative of a likelihood of clinical benefit of treatment of a patient having cancer, particularly a colorectal cancer, with chemotherapy, particularly 5-FU therapy.

It is desirable to correct for (normalize away) both differences in the amount of RNA assayed and variability in the quality of the RNA used. Therefore, the assay typically measures, and expression analysis of a marker gene incorporates analysis of, the expression of certain reference genes (or "normalizing genes"), including well known housekeeping genes, such as GAPDH. Alternatively, normalization can be based on the mean or median signal (Ct) of all of the assayed genes or a large subset thereof (often referred to as a "global normalization" approach). On a gene-by-gene basis, measured normalized amount of a patient tumor mRNA may be compared to the amount found in a colon cancer tissue reference set. See M. Cronin, et al., Am. Soc. Investigative Pathology 164:35-42 (2004).

The genes assayed can include one or more (e.g., two or more, three or more, etc.) of the genes listed in Table 5, and/or a gene that is co-expressed with a gene listed in Table 5. As shown in the Examples below, increased expression of AURKB, Axin 2, B1K, BRAF, BRCA2, BUB1, C20 orf1, C20ORF126, CASP9, CCNE2 variant 1, CDC2, CDC4, CENPA, CENPF, CLIC1, CYR61, Cdx2, Chk1, DLC1, DUSP1, E2F1, EGR3, E124, ESPL1, FBXO5, FGF2, FOS, FUT6, GSK3B, Grb10, HES6, HLA-G, HNRPAB, HOXB13, HSPE1, KIF22, KIFC1, KLRK1, Ki-67, LAT, LMYC, MAD2L1, MSH2, MSH3, NR4A1, PDGFA, PRDX2, RAB32, RAD54L, RANBP2, RCC1, ROCK2, RhoB, S100P, SAT, SOD1, SOS1, STK15, TCF-1, TOP2A, TP53BP1, UBE2C, VCP, and cMYC is positively correlated to an increased likelihood of a positive clinical response to treatment with chemotherapy; and increased expression of one or more of the genes selected from the group consisting of ABCB1, AMFR, ANXA1, APC, B-Catenin, BGN, CALD1, CD44E, CD44s, CD44v6, CD68, CDH11, CHFR, CLDN1, CLTC, COL1A1, COL1A2, CREBBP, CTSB, CTSL, CXCL12, EFNB2, ENO1, EPAS1, FGF18, FOXO3A, FPGS, FZD1, GJB2, GPX1, HIF1A, HNRPD, HSD17B2, HoxA5, IGFBP3, IGFBP5, IGFBP7, IL6ST, ITGA5, KLF5, KLK10, KRT8, LEF, LOX, MADH7, MCM3, MCP1, MMP1, MMP2, Maspin, NRP1, PDGFC, PDGFD, PDGFRa, PFN2, PKR2, RUNX1, SEMA4B, SIAT4A, SKP2, SPARC, SPRY1, THBS1, TIMP1, UPP1, and VDAC2 is negatively correlated to an increased likelihood of a positive response to treatment with chemotherapy.

Genes that exhibit an expression pattern that directly correlates with that of a gene of Table 5 are referred to herein as "co-expressed genes" or "substitute genes". Such genes can be assayed in lieu of the gene with which it exhibits co-expression, or can be assayed in combination with the gene with which it is co-expressed (e.g., as an internal control or to increase statistical power). Suitable co-expressed genes that exhibit co-expression with a gene of Table 5 are provided in Table C.

Design of Primers and Probes

Primers and probes (e.g., for use in PCR amplification-based methods) can be designed based upon exon sequence or upon intron sequences present in the gene to be amplified. Accordingly, the first step in the primer/probe design is the delineation of a target exon or intron sequence within the gene of interest. This can be done by publicly available software, such as the DNA BLAT software developed by Kent, W. J., *Genome Res.* 12(4):656-64 (2002), or by the BLAST software including its variations. Subsequent steps follow well established methods of PCR primer and probe design.

In order to avoid non-specific signals, repetitive sequences within the target sequence of the gene can be masked when designing the primers and probes. This can be easily accomplished by using the Repeat Masker program available on-line through the Baylor College of Medicine, which screens DNA sequences against a library of repetitive elements and returns a query sequence in which the repetitive elements are masked. The masked sequences can then be used to design primer and probe sequences using any commercially or otherwise publicly available primer/probe design packages, such as Primer Express (Applied Biosystems); MGB assay-by-design (Applied Biosystems); Primer3 (Steve Rozen and Helen J. Skaletsky (2000) Primer3 on the WWW for general users and for biologist programmers. In: Krawetz S, Misener S (eds) *Bioinformatics Methods and Protocols: Methods in Molecular Biology*. Humana Press, Totowa, N. J., pp 365-386).

The factors that to be considered in PCR primer design can include primer length, melting temperature (Tm), and G/C content, specificity, complementary primer sequences, and 3'-end sequence. In general, optimal PCR primers are generally 17-30 bases in length, and contain about 20-80%, such as, for example, about 50-60% G+C bases. Tm's between 50 and 80° C., e.g. about 50 to 70° C. are typically preferred.

For further guidelines for PCR primer and probe design see, e.g. Dieffenbach, C. W. et al., "General Concepts for PCR Primer Design" in: *PCR Primer, A Laboratory Manual*, Cold Spring Harbor Laboratory Press, New York, 1995, pp. 133-155; Innis and Gelfand, "Optimization of PCRs" in: *PCR Protocols, A Guide to Methods and Applications*, CRC Press, London, 1994, pp. 5-11; and Plasterer, T. N. Primerselect: Primer and probe design. *Methods Mol. Biol.* 70:520-527 (1997), the entire disclosures of which are hereby expressly incorporated by reference.

Kits

The materials for use in the methods of the present disclosure are suited for preparation of kits produced in accordance with well known procedures. The present disclosure thus provides kits comprising agents, which may include gene-specific or gene-selective probes and/or primers, for quantitating the expression of the disclosed genes for predicting clinical outcome or response to treatment. Such kits may optionally contain reagents for the extraction of RNA from tumor samples, in particular fixed paraffin-embedded tissue samples and/or reagents for RNA amplification. In addition, the kits may optionally comprise the reagent(s) with an identifying description or label or instructions relating to their use in the methods of the present disclosure. The kits may comprise containers (including microtiter plates suitable for use in an automated implementation of the method), each with one or more of the various reagents (typically in concentrated form) utilized in the methods, including, for example, pre-fabricated microarrays, buffers, the appropriate nucleotide triphosphates (e.g., dATP, dCTP, dGTP and dTTP; or rATP, rCTP, rGTP and UTP), reverse transcriptase, DNA polymerase, RNA polymerase, and one or more probes and primers of the present disclosure (e.g., appropriate length poly(T) or random primers linked to a promoter reactive with the RNA polymerase). Mathematical algorithms used to estimate or quantify prognostic and/or predictive information are also properly potential components of kits.

The methods provided by the present disclosure may also be automated in whole or in part.

Reports

The methods of the present disclosure are suited for the preparation of reports summarizing the predictions resulting from the methods of the present disclosure. A "report," as described herein, is an electronic or tangible document which includes report elements that provide information of interest relating to a likelihood assessment and its results. A subject report includes at least a likelihood assessment, e.g., an indication as to the likelihood that a cancer patient will exhibit a beneficial clinical response to a 5FU treatment regimen. A subject report can be completely or partially electronically generated, e.g., presented on an electronic display (e.g., computer monitor). A report can further include one or more of: 1) information regarding the testing facility; 2) service provider information; 3) patient data; 4) sample data; 5) an interpretive report, which can include various information including: a) indication; b) test data, where test data can include a normalized level of one or more genes of interest, and 6) other features.

The present disclosure thus provides for methods of creating reports and the reports resulting therefrom. The report may include a summary of the expression levels of the RNA transcripts, or the expression products of such RNA transcripts, for certain genes in the cells obtained from the patients tumor tissue. The report may include a prediction that said subject has an increased likelihood of response to treatment with a particular chemotherapy or the report may include a prediction that the subject has a decreased likelihood of response to the chemotherapy. The report may include a recommendation for treatment modality such as surgery alone or surgery in combination with chemotherapy. The report may be presented in electronic format or on paper.

Thus, in some embodiments, the methods of the present disclosure further includes generating a report that includes information regarding the patient's likelihood of response to chemotherapy, particularly an 5FU-based therapy. For example, the methods disclosed herein can further include a step of generating or outputting a report providing the results of a subject response likelihood assessment, which report can be provided in the form of an electronic medium (e.g., an electronic display on a computer monitor), or in the form of a tangible medium (e.g., a report printed on paper or other tangible medium).

A report that includes information regarding the likelihood that a patient will respond to treatment with chemotherapy, particularly a 5-FU-based therapy, is provided to a user. An assessment as to the likelihood that a cancer patient will respond to treatment with chemotherapy, particularly a 5FU-based therapy, is referred to below as a "response likelihood assessment" or, simply, "likelihood assessment." A person or entity who prepares a report ("report generator") will also perform the likelihood assessment. The report generator may also perform one or more of sample gathering, sample processing, and data generation, e.g., the report generator may also perform one or more of: a) sample gathering; b) sample processing; c) measuring a level of an indicator response gene product(s); d) measuring a level of a reference gene product(s); and e) determining a normalized level of a response indicator gene product(s). Alternatively, an entity other than the report generator can perform one or more sample gathering, sample processing, and data generation.

For clarity, it should be noted that the term "user," which is used interchangeably with "client," is meant to refer to a person or entity to whom a report is transmitted, and may be the same person or entity who does one or more of the following: a) collects a sample; b) processes a sample; c) provides a sample or a processed sample; and d) generates data (e.g., level of a response indicator gene product(s); level of a reference gene product(s); normalized level of a response indicator gene product(s)) for use in the likelihood assessment. In some cases, the person(s) or entity(ies) who provides sample collection and/or sample processing and/or data generation, and the person who receives the results and/or report may be different persons, but are both referred to as "users" or "clients" herein to avoid confusion. In certain embodiments, e.g., where the methods are completely executed on a single computer, the user or client provides for data input and review of data output. A "user" can be a health professional (e.g., a clinician, a laboratory technician, a physician (e.g., an oncologist, surgeon, pathologist), etc.).

In embodiments where the user only executes a portion of the method, the individual who, after computerized data processing according to the methods of the invention, reviews data output (e.g., results prior to release to provide a complete report, a complete, or reviews an "incomplete" report and provides for manual intervention and completion of an interpretive report) is referred to herein as a "reviewer." The reviewer may be located at a location remote to the user (e.g., at a service provided separate from a healthcare facility where a user may be located).

Where government regulations or other restrictions apply (e.g., requirements by health, malpractice, or liability insurance), all results, whether generated wholly or partially electronically, are subjected to a quality control routine prior to release to the user.

Computer-Based Systems and Methods

The methods and systems described herein can be implemented in numerous ways. In one embodiment of particular interest, the methods involve use of a communications infrastructure, for example the internet. Several embodiments of the invention are discussed below. It is also to be understood that the present invention may be implemented in various forms of hardware, software, firmware, processors, or a combination thereof. The methods and systems described herein can be implemented as a combination of hardware and software. The software can be implemented as an application program tangibly embodied on a program storage device, or different portions of the software implemented in the user's computing environment (e.g., as an applet) and on the reviewer's computing environment, where the reviewer may be located at a remote site associated (e.g., at a service provider's facility).

For example, during or after data input by the user, portions of the data processing can be performed in the user-side computing environment. For example, the user-side computing environment can be programmed to provide for defined test codes to denote a likelihood "score," where the score is transmitted as processed or partially processed responses to the reviewer's computing environment in the form of test code for subsequent execution of one or more algorithms to provide a results and/or generate a report in the reviewer's computing environment. The score can be a numerical score (representative of a numerical value) or a non-numerical score representative of a numerical value or range of numerical values (e.g., "A" representative of a 90-95% likelihood of an outcome; "high" representative of a greater than 50% chance of response (or some other selected threshold of likelihood); "low" representative of a less than 50% chance of response (or some other selected threshold of likelihood); and the like.

The application program for executing the algorithms described herein may be uploaded to, and executed by, a machine comprising any suitable architecture. In general, the machine involves a computer platform having hardware such as one or more central processing units (CPU), a random access memory (RAM), and input/output (I/O) interface(s). The computer platform also includes an operating system and microinstruction code. The various processes and functions described herein may either be part of the microinstruction code or part of the application program (or a combination thereof) which is executed via the operating system. In addition, various other peripheral devices may be connected to the computer platform such as an additional data storage device and a printing device.

As a computer system, the system generally includes a processor unit. The processor unit operates to receive information, which can include test data (e.g., level of a response indicator gene product(s); level of a reference gene product(s); normalized level of a response indicator gene product(s)); and may also include other data such as patient data. This information received can be stored at least temporarily in a database, and data analyzed to generate a report as described above.

Part or all of the input and output data can also be sent electronically; certain output data (e.g., reports) can be sent electronically or telephonically (e.g., by facsimile, e.g., using devices such as fax back). Exemplary output receiving devices can include a display element, a printer, a facsimile device and the like. Electronic forms of transmission and/or display can include email, interactive television, and the like. In an embodiment of particular interest, all or a portion of the input data and/or all or a portion of the output data (e.g., usually at least the final report) are maintained on a web server for access, preferably confidential access, with typical browsers. The data may be accessed or sent to health professionals as desired. The input and output data, including all or a portion of the final report, can be used to populate a patient's medical record which may exist in a confidential database at the healthcare facility.

A system for use in the methods described herein generally includes at least one computer processor (e.g., where the method is carried out in its entirety at a single site) or at least two networked computer processors (e.g., where data is to be input by a user (also referred to herein as a "client") and transmitted to a remote site to a second computer processor for analysis, where the first and second computer processors are connected by a network, e.g., via an intranet or internet). The system can also include a user component(s) for input; and a reviewer component(s) for review of data, generated reports, and manual intervention. Additional components of the system can include a server component(s); and a database(s) for storing data (e.g., as in a database of report elements, e.g., interpretive report elements, or a relational database (RDB) which can include data input by the user and data output. The computer processors can be processors that are typically found in personal desktop computers (e.g., IBM, Dell, Macintosh), portable computers, mainframes, minicomputers, or other computing devices.

The networked client/server architecture can be selected as desired, and can be, for example, a classic two or three tier client server model. A relational database management system (RDMS), either as part of an application server component or as a separate component (RDB machine) provides the interface to the database.

In one example, the architecture is provided as a database-centric client/server architecture, in which the client application generally requests services from the application server which makes requests to the database (or the database server) to populate the report with the various report elements as required, particularly the interpretive report elements, especially the interpretation text and alerts. The server(s) (e.g., either as part of the application server machine or a separate RDB/relational database machine) responds to the client's requests.

The input client components can be complete, stand-alone personal computers offering a full range of power and features to run applications. The client component usually operates under any desired operating system and includes a communication element (e.g., a modem or other hardware for connecting to a network), one or more input devices (e.g., a keyboard, mouse, keypad, or other device used to transfer information or commands), a storage element (e.g., a hard drive or other computer-readable, computer-writable storage medium), and a display element (e.g., a monitor, television, LCD, LED, or other display device that conveys information to the user). The user enters input commands into the computer processor through an input device. Generally, the user interface is a graphical user interface (GUI) written for web browser applications.

The server component(s) can be a personal computer, a minicomputer, or a mainframe and offers data management, information sharing between clients, network administration and security. The application and any databases used can be on the same or different servers.

Other computing arrangements for the client and server(s), including processing on a single machine such as a mainframe, a collection of machines, or other suitable configuration are contemplated. In general, the client and server machines work together to accomplish the processing of the present invention.

Where used, the database(s) is usually connected to the database server component and can be any device which will hold data. For example, the database can be a any magnetic or optical storing device for a computer (e.g., CDROM, internal hard drive, tape drive). The database can be located remote to the server component (with access via a network, modem, etc.) or locally to the server component.

Where used in the system and methods, the database can be a relational database that is organized and accessed according to relationships between data items. The relational database is generally composed of a plurality of tables (entities). The rows of a table represent records (collections of information about separate items) and the columns represent fields (particular attributes of a record). In its simplest conception, the relational database is a collection of data entries that "relate" to each other through at least one common field.

Additional workstations equipped with computers and printers may be used at point of service to enter data and, in some embodiments, generate appropriate reports, if desired. The computer(s) can have a shortcut (e.g., on the desktop) to launch the application to facilitate initiation of data entry, transmission, analysis, report receipt, etc. as desired.

Computer-readable Storage Media

The present disclosure also contemplates a computer-readable storage medium (e.g. CD-ROM, memory key, flash memory card, diskette, etc.) having stored thereon a program which, when executed in a computing environment, provides for implementation of algorithms to carry out all or a portion of the results of a response likelihood assessment as described herein. Where the computer-readable medium contains a complete program for carrying out the methods described herein, the program includes program instructions for collecting, analyzing and generating output, and generally includes computer readable code devices for interacting with a user as described herein, processing that data in conjunction with analytical information, and generating unique printed or electronic media for that user.

Where the storage medium provides a program which provides for implementation of a portion of the methods described herein (e.g., the user-side aspect of the methods (e.g., data input, report receipt capabilities, etc.)), the program provides for transmission of data input by the user (e.g., via the internet, via an intranet, etc.) to a computing environment at a remote site. Processing or completion of processing of the data is carried out at the remote site to generate a report. After review of the report, and completion of any needed manual intervention, to provide a complete report, the complete report is then transmitted back to the user as an electronic document or printed document (e.g., fax or mailed paper report). The storage medium containing a program according to the invention can be packaged with instructions (e.g., for program installation, use, etc.) recorded on a suitable substrate or a web address where such instructions may be obtained. The computer-readable storage medium can also be provided in combination with one or more reagents for carrying out response likelihood assessment (e.g., primers, probes, arrays, or other such kit components).

All aspects of the present disclosure may also be practiced such that a limited number of additional genes that are co-expressed with the disclosed genes, for example as evidenced by high Pearson correlation coefficients, are included in a prognostic and/or predictive test in addition to and/or in place of disclosed genes.

Having described the invention, the same will be more readily understood through reference to the following Examples, which are provided by way of illustration, and are not intended to limit the invention in any way. All citations throughout the disclosure are hereby expressly incorporated by reference.

EXAMPLE 1

A Study to Identify Relationships Between Genomic Tumor Expression Profiles and the Likelihood of Recurrence in Dukes' B and Duke'S C Colon Cancer Patients Treated with Resection of the Colon The primary objective of this study was to determine whether there is a significant relationship between the expression of each of 751 test genes identified in Table B and clinical outcome in stage II and stage III colon cancer patients who receive colon resection (surgery) without chemotherapy.

Table A shows qRT-PCR and primer and probe sequences for all test and reference genes included in the studies described in the Examples. Reagt=Reagent; FPr=Forward Primer; RPr=Reverse Primer Table B shows target amplicons for all test and reference genes included in the studies described in the Examples.

Study Design

This study used tissue and outcome data from National Surgical Adjuvant Breast and Bowel Project (NSABP) Studies C-01 and C-02 in up to 400 Dukes B (stage II) and Dukes C (stage III) patients who received colon resection (surgery) only or surgery and postoperative Bacillus Calmette-Guerin (BCG).

Inclusion Criteria

Patients enrolled in either NSABP Study C-01: "A Clinical Trial To Evaluate Postoperative Immunotherapy And Postoperative Systemic Chemotherapy In The Management Of Resectable Colon Cancer" or NSABP Study C-02: "A Protocol To Evaluate The Postoperative Portal Vein Infusion Of 5-Fluorouracil And Heparin In Adenocarcinoma Of The Colon" Details of C-01 and C-02 can be found on the NSABP Website at the following URL: www.nsabp.pitt.edu/NSABP_Protocols.htm#treatment%20closed Tissue samples from the surgery only and surgery+postoperative BCG arms of NSABP C01 and from the surgery only arm of NSABP C02 surgery were combined into one sample set.

Exclusion Criteria

Patients enrolled in NSABP Study C-01 or NSABP Study C-02 were excluded from the present study if one or more of the following applied:

No tumor block available from initial diagnosis in the NSABP archive.

Insufficient tumor in block as assessed by examination of hematoxylin and eosin (H&E) slide.

Insufficient RNA (<700 ng) recovered from tissue sections for RT-PCR analysis.

Of 1943 patients enrolled in NSABP Study C-01 or NSABP Study C-02, 270 patient samples were available after application of exclusion criteria and used in the gene expression study disclosed herein. The overall demographic and clinical characteristics of the 270 included samples were similar to the original NSABP combined cohorts.

Gene Panel

Seven hundred fifty-seven genes, including reference genes (ATP5E, CLTC, GPX1, NEDD8, PGK1, UBB), were chosen for expression analysis. These genes are listed in Table A together with the sequences of primers and probes used in qRT-PCR to determine expression level.

Experimental Materials and Methods

The expression of 751 cancer-related test genes and 6 genes designated for use as reference genes was quantitatively assessed for each patient using TaqMan® RT-PCR, which was performed in singlet with RNA input at 1 nanogram per reaction.

Data Analysis Methods

Reference Normalization

For normalization of extraneous effects, cycle threshold ($C_T$) measurements obtained by RT-PCR were normalized relative to the mean expression of a set of reference genes. The resulting reference-normalized expression measurements typically range from 0 to 15, where a one unit increase generally reflects a 2-fold increase in RNA quantity.

Comparison of Study Cohort to Original NSABP Study Populations

We compared the distribution of clinical and demographic variables for the current study cohort of evaluable tissue blocks versus the original NSABP C-01 and C-02 study populations. There were no clinically meaningful differences in the distributions.

Univariate Analysis

For each of the 751 genes under study, we used the Cox proportional hazard model to examine the relationship between gene expression and recurrence free interval (RFI). The likelihood ratio was used as the test of statistical significance. The method of Benjamini and Hochberg (Benjamini, Y. and Hochberg, Y. (1995). Controlling the false discovery rate: a practical and powerful approach to multiple testing. J. R. Statist. Soc. B 57, 289-300.), as well as resampling and permutation based methods (Tusher V G, Tibshirani R, Chu G (2001) Significance analysis of microarrays applied to the ionizing radiation response. Proc Natl Acad Sci USA, 98:5116-5121.; Storey J D, Tibshirani R (2001) Estimating false discovery rates under dependence, with applications to DNA microarrays. Stanford: Stanford University, Department of Statistics; Report No.: Technical Report 2001-28.; Korn E L, Troendle J, McShane L, Simon R (2001) Controlling the number of false discoveries: Application to high-dimensional genomic data. Technical Report 003. 2001. National Cancer Institute.) were applied to the resulting set of p-values to estimate false discovery rates All analyses were repeated for each of the alternative endpoints: distant recurrence free interval (DRFI), overall survival (OS), and disease free survival (DFS).

Study Results

Table 1A shows associations for those genes whose increased expression is predictive of shorter Recurrence-Free Interval (RFI) in untreated patients (surgical resection only) based on univariate proportional hazards analysis. Table 1A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using RFI as the metric for clinical outcome.

TABLE 1A

| Gene | Hazard Ratio | P Value | Official Symbol | Accession Number |
|---|---|---|---|---|
| RARB | 2.22 | 0.0294 | RARB | NM_016152 |
| ITGB1 | 2.04 | 0.0002 | ITGB1 | NM_002211 |
| ANXA2 | 1.78 | 0.0003 | ANXA2 | NM_004039 |
| CYP3A4 | 1.68 | 0.0075 | CYP3A4 | NM_017460 |
| COX2 | 1.64 | 0.0604 | PTGS2 | NM_000963 |
| KRAS2 | 1.62 | 0.0064 | KRAS | NM_004985 |
| TJP1 | 1.58 | 0.0751 | TJP1 | NM_003257 |
| KIAA0125 | 1.58 | 0.0889 | KIAA0125 | NM_014792 |
| RhoB | 1.57 | 0.0002 | RHOB | NM_004040 |
| RhoC | 1.56 | 0.0059 | RHOC | NM_175744 |
| NTN1 | 1.54 | 0.0336 | NTN1 | NM_004822 |
| ANXA5 | 1.52 | 0.0086 | ANXA5 | NM_001154 |
| TIMP1 | 1.52 | <.0001 | TIMP1 | NM_003254 |
| AKT3 | 1.50 | <.0001 | AKT3 | NM_005465 |
| CALD1 | 1.48 | 0.0007 | CALD1 | NM_004342 |
| IGFBP7 | 1.46 | 0.0023 | IGFBP7 | NM_001553 |
| CYP1B1 | 1.45 | 0.0222 | CYP1B1 | NM_000104 |
| BGN | 1.44 | 0.0002 | BGN | NM_001711 |
| VEGFC | 1.44 | 0.0151 | VEGFC | NM_005429 |
| DLC1 | 1.44 | 0.0014 | DLC1 | NM_006094 |
| SI | 1.42 | 0.0086 | SI | NM_001041 |
| TIMP2 | 1.42 | 0.0022 | TIMP2 | NM_003255 |
| CDC42BPA | 1.41 | 0.0038 | CDC42BPA | NM_003607 |
| LAMC2 | 1.40 | 0.0004 | LAMC2 | NM_005562 |
| ITGAV | 1.40 | 0.0019 | ITGAV | NM_002210 |
| CTSB | 1.40 | 0.0357 | CTSB | NM_001908 |
| DUSP1 | 1.39 | <.0001 | DUSP1 | NM_004417 |
| TLN1 | 1.39 | 0.0335 | TLN1 | NM_006289 |
| CCNE2 variant 1 | 1.39 | 0.0708 | CCNE2 | NM_057749 |
| TIMP3 | 1.38 | 0.0023 | TIMP3 | NM_000362 |
| GHI BRAF mut4 | 1.38 | 0.0537 | | GHI_BRAF_mut4 |
| HB-EGF | 1.38 | 0.0109 | HBEGF | NM_001945 |
| HSPG2 | 1.38 | 0.0258 | HSPG2 | NM_005529 |
| VIM | 1.37 | 0.0077 | VIM | NM_003380 |
| ROCK1 | 1.37 | 0.0168 | ROCK1 | NM_005406 |
| S100A1 | 1.36 | 0.0233 | S100A1 | NM_006271 |
| p21 | 1.36 | 0.0113 | CDKN1A | NM_000389 |
| CGB | 1.36 | 0.0023 | CGB | NM_000737 |
| UBC | 1.36 | 0.0137 | UBC | NM_021009 |
| GADD45B | 1.36 | 0.0003 | GADD45B | NM_015675 |
| INHBA | 1.35 | 0.0010 | INHBA | NM_002192 |
| VCL | 1.34 | 0.0286 | VCL | NM_003373 |
| SIR2 | 1.34 | 0.0049 | SIRT1 | NM_012238 |
| CD68 | 1.34 | 0.0042 | CD68 | NM_001251 |
| Maspin | 1.34 | <.0001 | SERPINB5 | NM_002639 |
| FST | 1.33 | 0.0326 | FST | NM_006350 |
| EPAS1 | 1.33 | 0.0306 | EPAS1 | NM_001430 |
| LOXL2 | 1.33 | 0.0076 | LOXL2 | NM_002318 |
| STC1 | 1.33 | 0.0119 | STC1 | NM_003155 |
| UNC5C | 1.32 | 0.0642 | UNC5C | NM_003728 |
| IGFBP5 | 1.32 | 0.0080 | IGFBP5 | NM_000599 |
| INHBB | 1.32 | 0.0643 | INHBB | NM_002193 |
| FAP | 1.32 | 0.0017 | FAP | NM_004460 |
| DKK1 | 1.31 | 0.0298 | DKK1 | NM_012242 |
| FYN | 1.31 | 0.0053 | FYN | NM_002037 |
| CTHRC1 | 1.31 | 0.0017 | CTHRC1 | NM_138455 |
| FOS | 1.31 | 0.0010 | FOS | NM_005252 |
| RBX1 | 1.31 | 0.0633 | RBX1 | NM_014248 |
| TAGLN | 1.31 | 0.0058 | TAGLN | NM_003186 |
| SBA2 | 1.31 | 0.0439 | WSB2 | NM_018639 |
| CYR61 | 1.30 | 0.0018 | CYR61 | NM_001554 |
| SPARC | 1.30 | 0.0117 | SPARC | NM_003118 |
| SNAI2 | 1.30 | 0.0076 | SNAI2 | NM_003068 |
| TMSB10 | 1.30 | 0.0757 | TMSB10 | NM_021103 |
| IGFBP3 | 1.30 | 0.0056 | IGFBP3 | NM_000598 |
| PDGFC | 1.29 | 0.0040 | PDGFC | NM_016205 |
| SLPI | 1.29 | 0.0026 | SLPI | NM_003064 |
| COL1A2 | 1.29 | 0.0087 | COL1A2 | NM_000089 |
| NRP2 | 1.29 | 0.0112 | NRP2 | NM_003872 |
| PRKCA | 1.29 | 0.0093 | PRKCA | NM_002737 |
| KLF6 | 1.29 | 0.0661 | KLF6 | NM_001300 |
| THBS1 | 1.28 | 0.0062 | THBS1 | NM_003246 |
| EGR1 | 1.28 | 0.0067 | EGR1 | NM_001964 |
| S100A4 | 1.28 | 0.0070 | S100A4 | NM_002961 |
| CXCR4 | 1.28 | 0.0089 | CXCR4 | NM_003467 |
| LAMA3 | 1.27 | 0.0024 | LAMA3 | NM_000227 |
| LOX | 1.26 | 0.0036 | LOX | NM_002317 |
| AKAP12 | 1.26 | 0.0046 | AKAP12 | NM_005100 |
| ADAMTS12 | 1.26 | 0.0109 | ADAMTS12 | NM_030955 |
| MCP1 | 1.25 | 0.0122 | CCL2 | NM_002982 |
| Grb10 | 1.25 | 0.0107 | GRB10 | NM_005311 |
| PTGER3 | 1.25 | 0.0240 | PTGER3 | NM_000957 |
| CRYAB | 1.25 | 0.0035 | CRYAB | NM_001885 |
| ANGPT2 | 1.25 | 0.0566 | ANGPT2 | NM_001147 |
| ANXA1 | 1.25 | 0.0353 | ANXA1 | NM_000700 |
| EphB6 | 1.24 | 0.0960 | EPHB6 | NM_004445 |
| PDGFB | 1.24 | 0.0139 | PDGFB | NM_002608 |
| COL1A1 | 1.24 | 0.0198 | COL1A1 | NM_000088 |
| TGFB3 | 1.23 | 0.0094 | TGFB3 | NM_003239 |
| CTGF | 1.23 | 0.0265 | CTGF | NM_001901 |
| PDGFA | 1.23 | 0.0312 | | NM_002607 |
| HSPA1A | 1.23 | 0.0027 | HSPA1A | NM_005345 |
| EFNB2 | 1.23 | 0.0331 | EFNB2 | NM_004093 |
| CAPG | 1.23 | 0.0724 | CAPG | NM_001747 |
| TGFBI | 1.22 | 0.0231 | TGFBI | NM_000358 |
| SIAT4A | 1.22 | 0.0253 | ST3GAL1 | NM_003033 |
| LAT | 1.22 | 0.0307 | LAT | NM_014387 |
| ITGA5 | 1.22 | 0.0224 | ITGA5 | NM_002205 |
| GBP2 | 1.22 | 0.0225 | GBP2 | NM_004120 |
| ANTXR1 | 1.22 | 0.0204 | ANTXR1 | NM_032208 |
| ID4 | 1.22 | 0.0512 | ID4 | NM_001546 |
| SFRP2 | 1.22 | 0.0039 | SFRP2 | NM_003013 |
| TMEPAI | 1.21 | 0.0170 | TMEPAI | NM_020182 |
| CTSL | 1.21 | 0.0388 | CTSL | NM_001912 |
| KLK10 | 1.21 | 0.0007 | KLK10 | NM_002776 |
| FXYD5 | 1.21 | 0.0547 | FXYD5 | NM_014164 |
| GJB2 | 1.21 | 0.0356 | GJB2 | NM_004004 |
| P14ARF | 1.21 | 0.0451 | | S78535 |
| DAPK1 | 1.21 | 0.0525 | DAPK1 | NM_004938 |
| SKP1A | 1.21 | 0.0663 | SKP1A | NM_006930 |
| SFRP4 | 1.21 | 0.0078 | SFRP4 | NM_003014 |
| KLK6 | 1.20 | 0.0048 | KLK6 | NM_002774 |
| GJA1 | 1.20 | 0.0345 | GJA1 | NM_000165 |
| HOXB7 | 1.20 | 0.0278 | HOXB7 | NM_004502 |
| NDRG1 | 1.20 | 0.0948 | NDRG1 | NM_006096 |
| PAI1 | 1.19 | 0.0061 | SERPINE1 | NM_000602 |
| CDH11 | 1.19 | 0.0762 | CDH11 | NM_001797 |
| EGR3 | 1.19 | 0.0149 | EGR3 | NM_004430 |
| EMP1 | 1.19 | 0.0533 | EMP1 | NM_001423 |
| FZD1 | 1.19 | 0.0671 | FZD1 | NM_003505 |
| ABCC5 | 1.19 | 0.0631 | ABCC5 | NM_005688 |
| S100P | 1.18 | 0.0160 | S100P | NM_005980 |
| OPN, osteopontin | 1.18 | 0.0030 | SPP1 | NM_000582 |
| p16-INK4 | 1.17 | 0.0503 | | L27211 |
| NR4A1 | 1.17 | 0.0332 | NR4A1 | NM_002135 |
| TUBB | 1.17 | 0.0950 | TUBB2 | NM_001069 |
| SIAT7B | 1.17 | 0.0352 | ST6GALNAC2 | NM_006456 |
| ALDH1A1 | 1.17 | 0.0299 | ALDH1A1 | NM_000689 |
| F3 | 1.16 | 0.0654 | F3 | NM_001993 |
| SLC2A1 | 1.15 | 0.0806 | SLC2A1 | NM_006516 |
| CXCL12 | 1.13 | 0.0986 | CXCL12 | NM_000609 |
| STMY3 | 1.13 | 0.0518 | MMP11 | NM_005940 |
| S100A2 | 1.13 | 0.0303 | S100A2 | NM_005978 |
| FABP4 | 1.13 | 0.0363 | FABP4 | NM_001442 |
| REG4 | 1.11 | 0.0034 | REG4 | NM_032044 |

TABLE 1A-continued

| Gene | Hazard Ratio | P Value | Official Symbol | Accession Number |
|---|---|---|---|---|
| pS2 | 1.09 | 0.0690 | TFF1 | NM_003225 |
| MUC2 | 1.06 | 0.0674 | MUC2 | NM_002457 |

Table 1B shows associations for those genes whose increased expression is predictive of longer Recurrence-Free Interval (RFI) in untreated patients (surgical resection only) based on univariate proportional hazards analysis. Table 1B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using RFI as the metric for clinical outcome.

TABLE 1B

| Gene | Hazard Ratio | P Value | Official Symbol | Accession Number |
|---|---|---|---|---|
| ORC1L | 0.41 | 0.0623 | ORC1L | NM_004153 |
| E2F1 | 0.63 | 0.0006 | E2F1 | NM_005225 |
| HSPA8 | 0.63 | 0.0346 | HSPA8 | NM_006597 |
| RAD54L | 0.65 | 0.0026 | RAD54L | NM_003579 |
| BRCA1 | 0.68 | 0.0001 | BRCA1 | NM_007295 |
| SLC25A3 | 0.70 | 0.0100 | SLC25A3 | NM_213611 |
| PPM1D | 0.71 | 0.0025 | PPM1D | NM_003620 |
| DHFR | 0.71 | 0.0106 | DHFR | NM_000791 |
| SKP2 | 0.72 | 0.0087 | SKP2 | NM_005983 |
| FASN | 0.73 | 0.0070 | FASN | NM_004104 |
| HNRPD | 0.73 | 0.0611 | HNRPD | NM_031370 |
| ENO1 | 0.74 | 0.0432 | ENO1 | NM_001428 |
| C20 orf1 | 0.74 | 0.0086 | TPX2 | NM_012112 |
| BRCA2 | 0.75 | 0.0515 | BRCA2 | NM_000059 |
| DDB1 | 0.75 | 0.0639 | DDB1 | NM_001923 |
| KIF22 | 0.76 | 0.0127 | KIF22 | NM_007317 |
| RPLPO | 0.76 | 0.0330 | RPLP0 | NM_001002 |
| Chk1 | 0.76 | 0.0164 | CHEK1 | NM_001274 |
| ST14 | 0.77 | 0.0392 | ST14 | NM_021978 |
| Bax | 0.77 | 0.0502 | BAX | NM_004324 |
| TCF-1 | 0.78 | 0.0023 | TCF1 | NM_000545 |
| LMNB1 | 0.78 | 0.0458 | LMNB1 | NM_005573 |
| RRM1 | 0.78 | 0.0693 | RRM1 | NM_001033 |
| CSEL1 | 0.79 | 0.0261 | CSE1L | NM_001316 |
| CDC20 | 0.79 | 0.0274 | CDC20 | NM_001255 |
| PRDX2 | 0.79 | 0.0930 | PRDX2 | NM_005809 |
| RPS13 | 0.79 | 0.0906 | RPS13 | NM_001017 |
| RAF1 | 0.80 | 0.0717 | RAF1 | NM_002880 |
| CMYC | 0.80 | 0.0095 | MYC | NM_002467 |
| UBE2M | 0.80 | 0.0390 | UBE2M | NM_003969 |
| CKS2 | 0.80 | 0.0596 | CKS2 | NM_001827 |
| NME1 | 0.80 | 0.0694 | NME1 | NM_000269 |
| c-myb (MYB official) | 0.80 | 0.0082 | MYB | NM_005375 |
| CD80 | 0.80 | 0.0688 | CD80 | NM_005191 |
| CDCA7 v2 | 0.81 | 0.0164 | CDCA7 | NM_145810 |
| EFP | 0.81 | 0.0387 | TRIM25 | NM_005082 |
| CCNE2 | 0.81 | 0.0405 | CCNE2 | NM_057749 |
| SURV | 0.81 | 0.0573 | BIRC5 | NM_001168 |
| RRM2 | 0.82 | 0.0181 | RRM2 | NM_001034 |
| ABCC6 | 0.82 | 0.0464 | ABCC6 | NM_001171 |
| UMPS | 0.82 | 0.0371 | UMPS | NM_000373 |
| PI3KC2A | 0.82 | 0.0855 | PIK3C2A | NM_002645 |
| NOTCH1 | 0.82 | 0.0222 | NOTCH1 | NM_017617 |
| EIF4E | 0.82 | 0.0928 | EIF4E | NM_001968 |
| EPHB2 | 0.82 | 0.0183 | EPHB2 | NM_004442 |
| AREG | 0.83 | 0.0012 | AREG | NM_001657 |
| EREG | 0.83 | 0.0059 | EREG | NM_001432 |
| MYBL2 | 0.83 | 0.0234 | MYBL2 | NM_002466 |
| ABCB1 | 0.83 | 0.0342 | ABCB1 | NM_000927 |
| HRAS | 0.83 | 0.0708 | HRAS | NM_005343 |
| SLC7A5 | 0.84 | 0.0547 | SLC7A5 | NM_003486 |
| MAD2L1 | 0.84 | 0.0653 | MAD2L1 | NM_002358 |
| ING5 | 0.85 | 0.0920 | ING5 | NM_032329 |
| Ki-67 | 0.85 | 0.0562 | MKI67 | NM_002417 |

TABLE 1B-continued

| Gene | Hazard Ratio | P Value | Official Symbol | Accession Number |
|---|---|---|---|---|
| MCM2 | 0.85 | 0.0671 | MCM2 | NM_004526 |
| Cdx2 | 0.88 | 0.0430 | CDX2 | NM_001265 |
| HES6 | 0.89 | 0.0966 | HES6 | NM_018645 |
| PTPRO | 0.89 | 0.0664 | PTPRO | NM_030667 |
| cripto (TDGF1 official) | 0.90 | 0.0781 | TDGF1 | NM_003212 |

The hazard ratios derived from the Cox proportional hazards regression model provided in Tables 1A and 1B provide an assessment of the contribution of the instantaneous risk of recurrence at time t conditional on a recurrence not occurring by time t. For an individual with gene expression measurement X, the instantaneous risk of recurrence at time t, $\lambda(t|X)$ is given by the relationship $\lambda(t|X) = \lambda_o(t) \cdot \exp[\beta \cdot X]$ where $\lambda_o(t)$ is the baseline hazard at time t and $\beta$ is the log hazard ratio ($\beta = \ln[HR]$) from Tables 1A or 1B. Furthermore, the survivor function at time t is given by $S(t|X) = S_o(t)^{\exp[\beta \cdot X]}$, where $=S_o(t)$ is the baseline survivor function at time t. Consequently, the risk of recurrence at time t for a patient with a gene expression measurement of X is given by $1-S(t|X)$. In this way, an individual patient's estimated risk of recurrence may be derived from an observed gene expression measurement. As an example, suppose the baseline estimate of survival at 3 years is 0.95. Then a patient with a gene expression measurement of 5 for INHBA would have an estimated risk of recurrence of approximately $1-0.95^{\exp[\ln(1.35) \cdot 4]} = 0.205$.

EXAMPLE 2

A Study to Identify Relationships Between Tumor Gene Expression Profiles and Recurrence-Free Interval in Dukes' B and Duke'S C Colon Cancer Patients Treated with Leucovorin-Modulated Fluorouracil After Resection of the Colon The primary objective of this study was to determine whether there is a significant relationship between the expression of each of 751 test genes identified in Table B and clinical outcome in stage II and stage III colon cancer patients who received chemotherapy with leucovorin-modulated fluorouracil after colon resection surgery. Improvement in a clinical endpoint such as recurrence free interval reflects an increased likelihood of response to treatment with FU/LV and an increased likelihood of a positive clinical outcome.

Study Design

This study used tissue and outcome data from National Surgical Adjuvant Breast and Bowel Project (NSABP) Study C04 in up to 360 Dukes B (stage II) and Dukes C (stage III) patients who received colon resection and postoperative treatment with 5-fluorouracil and leucovorin.

Inclusion Criteria

Enrollment in NSABP Study C-04: "A Clinical Trial to Assess the Relative Efficacy of Fluorouracil and Leucovorin, Fluorouracil and Levamisole, and Fluorouracil, Leucovorin, and Levamisole in Patients With Dukes' B and C Carcinoma of the Colon" and randomization to leucovorin-modulated fluorouracil (LV+5-FU) arm of the study. Details of C-04 can be found on the NSABP Website at the following URL: www.nsabp.pitt.edu/NSABP_Protocols.htm#treatment%20closed.

Exclusion Criteria

Patients enrolled in NSABP Study C-04 were excluded from the present study if one or more of the following applied:

No tumor block available from initial diagnosis in the NSABP archive.

Insufficient tumor in block as assessed by examination of hematoxylin and eosin (H&E) slide.

Insufficient RNA (<700 ng) recovered from tissue sections for RT-PCR analysis.

Pathologically ineligible.

Clinically ineligible.

Of 1943 patients enrolled in NSABP Study C-04, 308 patient samples were available after application of exclusion criteria and used in the gene expression study disclosed herein. The overall demographic and clinical characteristics of the 308 included samples were similar to the original NSABP combined cohorts.

Gene Panel

Seven hundred fifty-seven genes, including reference genes (ATP5E, CLTC, GPX1, NEDD8, PGK1, UBB), were chosen for expression analysis. These genes are listed in Table A together with the sequences of primers and probes used in qRT-PCR to determine expression level.

Experimental Materials and Methods

The expression of 751 cancer-related test genes plus six genes designated for use as reference genes was quantitatively assessed for each patient using TaqMan® RT-PCR, which was performed in singlet with RNA input at 1 nanogram per reaction.

Data Analysis Methods

Reference Normalization

For normalization of extraneous effects, cycle threshold ($C_T$) measurements obtained by RT-PCR were normalized relative to the mean expression of a set of reference genes. The resulting reference-normalized expression measurements typically range from 0 to 15, where a one unit increase generally reflects a 2-fold increase in RNA quantity.

Comparison of Study Cohort to Original NSABP Study Populations

The distribution of clinical and demographic variables for the current study cohort of evaluable tissue blocks was compared to the original NSABP C-04 study population. There were no clinically meaningful differences in the distributions.

Univariate Analysis

For each of the 751 genes under study, the Cox proportional hazard model was used to examine the relationship between gene expression and recurrence free interval (RFI). The likelihood ratio was used as the test of statistical significance. The method of Benjamini and Hochberg (Benjamini, Y. and Hochberg, Y. (1995). Controlling the false discovery rate: a practical and powerful approach to multiple testing. J. R. Statist. Soc. B 57, 289-300.), as well as resampling and permutation based methods (Tusher V G, Tibshirani R, Chu G (2001) Significance analysis of microarrays applied to the ionizing radiation response. Proc Natl Acad Sci USA, 98:5116-5121; Storey J D, Tibshirani R (2001) Estimating false discovery rates under dependence, with applications to DNA microarrays. Stanford: Stanford University, Department of Statistics; Report No.: Technical Report 2001-28.; Korn E L, Troendle J, McShane L, Simon R (2001) Controlling the number of false discoveries: Application to high-dimensional genomic data. Technical Report 003. 2001. National Cancer Institute.) were applied to the resulting set of p-values to estimate false discovery rates.

Table 2A shows associations for those genes whose increased expression is predictive of shorter Recurrence-Free Interval (RFI) in treated patients (surgical resection and 5-FU/LV) based on univariate proportional hazards analysis.

TABLE 2A

| Gene | Hazard Ratio | P Value | Official Symbol | Accession Number |
|---|---|---|---|---|
| CYR61 | 1.44 | 0.0003 | CYR61 | NM_001554 |
| FABP4 | 1.20 | 0.0014 | FABP4 | NM_001442 |
| CTGF | 1.38 | 0.0024 | CTGF | NM_001901 |
| CYP1B1 | 1.54 | 0.0024 | CYP1B1 | NM_000104 |
| IGFBP3 | 1.40 | 0.0037 | IGFBP3 | NM_000598 |
| PDGFC | 1.40 | 0.0041 | PDGFC | NM_016205 |
| P14ARF | 1.32 | 0.0043 | | S78535 |
| MAP2 | 2.89 | 0.0044 | MAP2 | NM_031846 |
| ID4 | 1.41 | 0.0054 | ID4 | NM_001546 |
| P16-INK4 | 1.29 | 0.0060 | | L27211 |
| PAI1 | 1.25 | 0.0074 | SERPINE1 | NM_000602 |
| SFRP2 | 1.22 | 0.0079 | SFRP2 | NM_003013 |
| NMB | 1.72 | 0.0081 | NMB | NM_021077 |
| INHA | 2.63 | 0.0087 | INHA | NM_002191 |
| MMP9 | 1.29 | 0.0095 | MMP9 | NM_004994 |
| FAP | 1.31 | 0.0104 | FAP | NM_004460 |
| GJB2 | 1.32 | 0.0112 | GJB2 | NM_004004 |
| LEF | 1.34 | 0.0126 | LEF1 | NM_016269 |
| BGN | 1.31 | 0.0129 | BGN | NM_001711 |
| SFRP4 | 1.25 | 0.0138 | SFRP4 | NM_003014 |
| EphB6 | 1.35 | 0.0148 | EPHB6 | NM_004445 |
| INHBA | 1.34 | 0.0149 | INHBA | NM_002192 |
| STC1 | 1.41 | 0.0161 | STC1 | NM_003155 |
| EPAS1 | 1.55 | 0.0168 | EPAS1 | NM_001430 |
| DLC1 | 1.36 | 0.0174 | DLC1 | NM_006094 |
| CXCR4 | 1.34 | 0.0174 | CXCR4 | NM_003467 |
| THY1 | 1.37 | 0.0184 | THY1 | NM_006288 |
| EMP1 | 1.29 | 0.0193 | EMP1 | NM_001423 |
| MADH7 | 1.37 | 0.0195 | SMAD7 | NM_005904 |
| CREBBP | 1.61 | 0.0196 | CREBBP | NM_004380 |
| K-ras | 1.35 | 0.0202 | KRAS | NM_033360 |
| FOXO3A | 1.30 | 0.0207 | FOXO3A | NM_001455 |
| IMP-1 | 1.90 | 0.0210 | IMP-1 | NM_006546 |
| HoxA5 | 1.28 | 0.0224 | HOXA5 | NM_019102 |
| PADI4 | 2.03 | 0.0225 | PADI4 | NM_012387 |
| AKT3 | 1.33 | 0.0226 | AKT3 | NM_005465 |
| CXCL12 | 1.23 | 0.0227 | CXCL12 | NM_000609 |
| EGR3 | 1.22 | 0.0235 | EGR3 | NM_004430 |
| TGFB3 | 1.25 | 0.0250 | TGFB3 | NM_003239 |
| RUNX1 | 1.42 | 0.0250 | RUNX1 | NM_001754 |
| EGR1 | 1.26 | 0.0265 | EGR1 | NM_001964 |
| Nkd-1 | 1.14 | 0.0271 | NKD1 | NM_033119 |
| SHC1 | 1.47 | 0.0280 | SHC1 | NM_003029 |
| SPARC | 1.32 | 0.0285 | SPARC | NM_003118 |
| UNC5B | 1.39 | 0.0293 | UNC5B | NM_170744 |
| ITGB3 | 1.31 | 0.0301 | ITGB3 | NM_000212 |
| CHFR | 1.27 | 0.0313 | CHFR | NM_018223 |
| WWOX | 1.77 | 0.0328 | WWOX | NM_016373 |
| VIM | 1.34 | 0.0339 | VIM | NM_003380 |
| TIMP1 | 1.32 | 0.0340 | TIMP1 | NM_003254 |
| VEGF_altsplice2 | 1.27 | 0.0340 | | AF214570 |
| VEGF | 1.34 | 0.0342 | VEGF | NM_003376 |
| PTP4A3 v2 | 1.26 | 0.0352 | PTP4A3 | NM_032611 |
| NRP2 | 1.28 | 0.0352 | NRP2 | NM_003872 |
| ANTXR1 | 1.25 | 0.0354 | ANTXR1 | NM_032208 |
| OPN, osteopontin | 1.15 | 0.0359 | SPP1 | NM_000582 |
| CEBPB | 1.51 | 0.0370 | CEBPB | NM_005194 |
| GADD45B | 1.27 | 0.0377 | GADD45B | NM_015675 |
| IL10 | 2.82 | 0.0381 | IL10 | NM_000572 |
| LOXL2 | 1.32 | 0.0403 | LOXL2 | NM_002318 |
| BCL2L11 | 1.39 | 0.0421 | BCL2L11 | NM_138621 |
| ANGPT2 | 1.35 | 0.0462 | ANGPT2 | NM_001147 |
| TGFB2 | 1.21 | 0.0462 | TGFB2 | NM_003238 |
| ABCC5 | 1.28 | 0.0467 | ABCC5 | NM_005688 |
| WISP1 | 1.27 | 0.0469 | WISP1 | NM_003882 |
| VEGFB | 1.42 | 0.0475 | VEGFB | NM_003377 |
| CRYAB | 1.22 | 0.0477 | CRYAB | NM_001885 |
| HSPA1A | 1.20 | 0.0481 | HSPA1A | NM_005345 |
| MCP1 | 1.23 | 0.0486 | CCL2 | NM_002982 |
| COL1A1 | 1.23 | 0.0498 | COL1A1 | NM_000088 |

Table 2B shows associations between clinical outcome and gene expression for those genes which demonstrated a Hazard Ratio<1.0 and for which p<0.05. Univariate Cox Proportional Hazards Regression analysis was applied in combined Stage II (Duke's B) and Stage III (Duke's C) patients using RFI after treatment with 5-FU/LV as the metric for clinical outcome.

TABLE 2B

| Gene | Hazard Ratio | P Value | Official Symbol | Accession Number |
|---|---|---|---|---|
| VCP | 0.52 | 0.0003 | VCP | NM_007126 |
| CKS2 | 0.61 | 0.0005 | CKS2 | NM_001827 |
| CDC20 | 0.67 | 0.0006 | CDC20 | NM_001255 |
| CDC2 | 0.69 | 0.0008 | CDC2 | NM_001786 |
| LMNB1 | 0.62 | 0.0009 | LMNB1 | NM_005573 |
| EI24 | 0.51 | 0.0009 | EI24 | NM_004879 |
| MAD2L1 | 0.70 | 0.0011 | MAD2L1 | NM_002358 |
| HNRPAB | 0.54 | 0.0014 | HNRPAB | NM_004499 |
| CCNB1 | 0.69 | 0.0015 | CCNB1 | NM_031966 |
| STK15 | 0.68 | 0.0017 | STK6 | NM_003600 |
| cdc25A | 0.30 | 0.0038 | CDC25A | NM_001789 |
| Chk1 | 0.68 | 0.0054 | CHEK1 | NM_001274 |
| UBE2C | 0.72 | 0.0062 | UBE2C | NM_007019 |
| ITGB4 | 0.70 | 0.0070 | ITGB4 | NM_000213 |
| SAT | 0.64 | 0.0071 | SAT | NM_002970 |
| MCM6 | 0.67 | 0.0077 | MCM6 | NM_005915 |
| SNRPF | 0.72 | 0.0080 | SNRPF | NM_003095 |
| TUBA1 | 0.69 | 0.0097 | TUBA1 | NM_006000 |
| HSPA8 | 0.45 | 0.0100 | HSPA8 | NM_006597 |
| BIK | 0.78 | 0.0104 | BIK | NM_001197 |
| PRDX4 | 0.66 | 0.0106 | PRDX4 | NM_006406 |
| H2AFZ | 0.64 | 0.0115 | H2AFZ | NM_002106 |
| CENPA | 0.70 | 0.0116 | CENPA | NM_001809 |
| BUB1 | 0.73 | 0.0118 | BUB1 | NM_004336 |
| Bax | 0.66 | 0.0130 | BAX | NM_004324 |
| MCM2 | 0.74 | 0.0144 | MCM2 | NM_004526 |
| TOP2A | 0.68 | 0.0156 | TOP2A | NM_001067 |
| Ki-67 | 0.77 | 0.0164 | MKI67 | NM_002417 |
| SLC25A3 | 0.56 | 0.0172 | SLC25A3 | NM_213611 |
| NEK2 | 0.66 | 0.0181 | NEK2 | NM_002497 |
| CENPE | 0.39 | 0.0195 | CENPE | NM_001813 |
| E2F1 | 0.69 | 0.0198 | E2F1 | NM_005225 |
| HSPE1 | 0.71 | 0.0198 | HSPE1 | NM_002157 |
| ODC1 | 0.73 | 0.0203 | ODC1 | NM_002539 |
| CLDN7 | 0.75 | 0.0203 | CLDN7 | NM_001307 |
| CSEL1 | 0.71 | 0.0204 | CSE1L | NM_001316 |
| MMP7 | 0.82 | 0.0228 | MMP7 | NM_002423 |
| CD24 | 0.83 | 0.0242 | CD24 | NM_013230 |
| C20 orf1 | 0.74 | 0.0249 | TPX2 | NM_012112 |
| BAD | 0.72 | 0.0259 | BAD | NM_032989 |
| CLIC1 | 0.61 | 0.0272 | CLIC1 | NM_001288 |
| F3 | 0.79 | 0.0272 | F3 | NM_001993 |
| TRAIL | 0.71 | 0.0285 | TNFSF10 | NM_003810 |
| NME1 | 0.73 | 0.0316 | NME1 | NM_000269 |
| GDF15 | 0.84 | 0.0317 | GDF15 | NM_004864 |
| c-myb (MYB official) | 0.79 | 0.0327 | MYB | NM_005375 |
| CD44R | 0.79 | 0.0335 | | X55150 |
| EIF4E | 0.69 | 0.0341 | EIF4E | NM_001968 |
| cMet | 0.80 | 0.0349 | MET | NM_000245 |
| AREG | 0.87 | 0.0377 | AREG | NM_001657 |
| CYP2C8 | 0.68 | 0.0392 | CYP2C8 | NM_000770 |
| PCNA | 0.77 | 0.0421 | PCNA | NM_002592 |
| SLC31A1 | 0.72 | 0.0437 | SLC31A1 | NM_001859 |
| MSH2 | 0.72 | 0.0450 | MSH2 | NM_000251 |
| PRDX2 | 0.67 | 0.0476 | PRDX2 | NM_005809 |
| TUFM | 0.77 | 0.0499 | TUFM | NM_003321 |

Analysis of Combined Study Results (Example 1 and Example 2)

The study presented in Example 1 identified genes for which a significant association was found between gene expression and recurrence-free interval in colon cancer patients treated solely by surgical resection of tumor. The study presented in Example 2 identified genes for which a significant association was found between gene expression and recurrence-free interval in colon cancer patients treated with 5-FU/LV (leucovorin-modulated fluorouracil) after surgical resection of tumor. In order to identify genes whose expression is associated specifically with response to 5-FU/LV, a test was performed to evaluate whether the Hazard Ratio associated with gene expression in surgery-only patients is sufficiently different from the Hazard Ratio associated with gene expression in surgery+5-FU/LV to conclude that gene expression is informative regarding response to 5-FU.

The results are shown in Table 3, which show Hazard Ratios and 75% Confidence Intervals for association between normalized expression values for a particular gene and the likelihood of response to 5-FU treatment. A gene with interaction HR>1 indicates higher recurrence risk after treatment and therefore a decreased likelihood of beneficial response as gene expression increases. A gene with interaction HR<1 indicates lower recurrence risk after treatment and therefore increased likelihood of beneficial response as gene expression increases. Results are shown for all genes for which the 75% Confidence Interval for Hazard Ratio doe not include HR=1. LCL and UCL indicate the lower confidence limit and the upper confidence limit respectively.

TABLE 3

Hazard Ratios and 75% Confidence Intervals for Prediction of Treatment Response Based on Gene Expression Levels

| Gene | Hazard Ratio (HR) | HR 75% LCL | HR 75% UCL | Official Symbol | Accession Number |
|---|---|---|---|---|---|
| ABCB1 | 1.16 | 1.003 | 1.346 | ABCB1 | NM_000927 |
| ABCC6 | 1.24 | 1.018 | 1.521 | ABCC6 | NM_001171 |
| AKAP12 | 0.84 | 0.724 | 0.979 | AKAP12 | NM_005100 |
| ANXA2 | 0.54 | 0.415 | 0.705 | ANXA2 | NM_004039 |
| BAD | 0.68 | 0.550 | 0.835 | BAD | NM_032989 |
| BCL2L11 | 1.28 | 1.023 | 1.611 | BCL2L11 | NM_138621 |
| BIK | 0.80 | 0.694 | 0.923 | BIK | NM_001197 |
| BRCA1 | 1.24 | 1.025 | 1.490 | BRCA1 | NM_007295 |
| BUB1 | 0.82 | 0.694 | 0.970 | BUB1 | NM_004336 |
| CCNB1 | 0.74 | 0.627 | 0.882 | CCNB1 | NM_031966 |
| CD24 | 0.84 | 0.739 | 0.948 | CD24 | NM_013230 |
| CDC2 | 0.71 | 0.608 | 0.840 | CDC2 | NM_001786 |
| CDCA7 v2 | 1.27 | 1.080 | 1.501 | CDCA7 | NM_145810 |
| CENPA | 0.67 | 0.552 | 0.823 | CENPA | NM_001809 |
| CENPE | 0.29 | 0.164 | 0.515 | CENPE | NM_001813 |
| CHFR | 1.20 | 1.019 | 1.418 | CHFR | NM_018223 |
| CKS2 | 0.78 | 0.636 | 0.965 | CKS2 | NM_001827 |
| CLDN7 | 0.77 | 0.636 | 0.926 | CLDN7 | NM_001307 |
| CLIC1 | 0.51 | 0.362 | 0.722 | CLIC1 | NM_001288 |
| CREBBP | 1.42 | 1.076 | 1.861 | CREBBP | NM_004380 |
| CTSL | 0.80 | 0.668 | 0.949 | CTSL | NM_001912 |
| CYP2C8 | 0.67 | 0.493 | 0.901 | CYP2C8 | NM_000770 |
| CYP3A4 | 0.62 | 0.458 | 0.835 | CYP3A4 | NM_017460 |
| DKK1 | 0.76 | 0.626 | 0.935 | DKK1 | NM_012242 |
| DUSP1 | 0.84 | 0.723 | 0.973 | DUSP1 | NM_004417 |
| EI24 | 0.63 | 0.489 | 0.825 | EI24 | NM_004879 |
| ENO1 | 1.31 | 1.043 | 1.657 | ENO1 | NM_001428 |
| F3 | 0.68 | 0.583 | 0.795 | F3 | NM_001993 |
| FOS | 0.86 | 0.740 | 0.994 | FOS | NM_005252 |
| GBP2 | 0.78 | 0.667 | 0.920 | GBP2 | NM_004120 |
| Grb10 | 0.81 | 0.688 | 0.959 | GRB10 | NM_005311 |
| H2AFZ | 0.72 | 0.566 | 0.927 | H2AFZ | NM_002106 |
| HNRPAB | 0.55 | 0.424 | 0.712 | HNRPAB | NM_004499 |
| HOXB7 | 0.81 | 0.692 | 0.939 | HOXB7 | NM_004502 |
| IMP-1 | 1.80 | 1.280 | 2.531 | IMP-1 | NM_006546 |
| INHA | 2.09 | 1.167 | 3.760 | INHA | NM_002191 |
| ITGAV | 0.77 | 0.617 | 0.950 | ITGAV | NM_002210 |
| ITGB1 | 0.61 | 0.439 | 0.836 | ITGB1 | NM_002211 |
| ITGB4 | 0.72 | 0.579 | 0.884 | ITGB4 | NM_000213 |
| KLK10 | 0.84 | 0.765 | 0.929 | KLK10 | NM_002776 |
| KLK6 | 0.88 | 0.786 | 0.977 | KLK6 | NM_002774 |
| KRAS2 | 0.61 | 0.439 | 0.834 | KRAS | NM_004985 |
| LAMA3 | 0.73 | 0.630 | 0.842 | LAMA3 | NM_000227 |
| LAMC2 | 0.69 | 0.582 | 0.808 | LAMC2 | NM_005562 |
| LAT | 0.79 | 0.662 | 0.941 | LAT | NM_014387 |
| LEF | 1.22 | 1.039 | 1.442 | LEF1 | NM_016269 |
| MAD2L1 | 0.84 | 0.715 | 0.990 | MAD2L1 | NM_002358 |
| MADH7 | 1.39 | 1.145 | 1.688 | SMAD7 | NM_005904 |
| MCM6 | 0.75 | 0.602 | 0.931 | MCM6 | NM_005915 |

TABLE 3-continued

Hazard Ratios and 75% Confidence Intervals for Prediction of Treatment Response Based on Gene Expression Levels

| Gene | Hazard Ratio (HR) | HR 75% LCL | HR 75% UCL | Official Symbol | Accession Number |
|---|---|---|---|---|---|
| MMP7 | 0.73 | 0.636 | 0.839 | MMP7 | NM_002423 |
| MMP9 | 1.36 | 1.181 | 1.555 | MMP9 | NM_004994 |
| MYBL2 | 1.19 | 1.020 | 1.380 | MYBL2 | NM_002466 |
| Maspin | 0.79 | 0.704 | 0.879 | SERPINB5 | NM_002639 |
| NEK2 | 0.71 | 0.545 | 0.925 | NEK2 | NM_002497 |
| NMB | 1.59 | 1.187 | 2.123 | NMB | NM_021077 |
| Nkd-1 | 1.11 | 1.017 | 1.212 | NKD1 | NM_033119 |
| ODC1 | 0.81 | 0.666 | 0.987 | ODC1 | NM_002539 |
| PCNA | 0.83 | 0.692 | 0.998 | PCNA | NM_002592 |
| PTP4A3 v2 | 1.30 | 1.108 | 1.522 | PTP4A3 | NM_032611 |
| REG4 | 0.92 | 0.863 | 0.972 | REG4 | NM_032044 |
| ROCK1 | 0.77 | 0.601 | 0.988 | ROCK1 | NM_005406 |
| RhoB | 0.66 | 0.531 | 0.819 | RHOB | NM_004040 |
| S100A2 | 0.88 | 0.792 | 0.976 | S100A2 | NM_005978 |
| S100P | 0.78 | 0.696 | 0.884 | S100P | NM_005980 |
| SAT | 0.64 | 0.502 | 0.823 | SAT | NM_002970 |
| SI | 0.76 | 0.593 | 0.985 | SI | NM_001041 |
| SIAT7B | 0.85 | 0.730 | 0.984 | ST6GALNAC2 | NM_006456 |
| SIR2 | 0.66 | 0.533 | 0.814 | SIRT1 | NM_012238 |
| SKP2 | 1.32 | 1.041 | 1.664 | SKP2 | NM_005983 |
| SLC31A1 | 0.76 | 0.612 | 0.938 | SLC31A1 | NM_001859 |
| SLPI | 0.78 | 0.679 | 0.905 | SLPI | NM_003064 |
| SNRPF | 0.73 | 0.606 | 0.868 | SNRPF | NM_003095 |
| STK15 | 0.77 | 0.645 | 0.916 | STK6 | NM_003600 |
| TCF-1 | 1.30 | 1.108 | 1.528 | TCF1 | NM_000545 |
| TGFB2 | 1.17 | 1.015 | 1.353 | TGFB2 | NM_003238 |
| TUBA1 | 0.73 | 0.590 | 0.892 | TUBA1 | NM_006000 |
| VCP | 0.63 | 0.495 | 0.809 | VCP | NM_007126 |
| VEGFC | 0.75 | 0.572 | 0.986 | VEGFC | NM_005429 |
| VEGF_altsplice2 | 1.19 | 1.009 | 1.406 | | AF214570 |
| Cdc25A | 0.28 | 0.160 | 0.488 | CDC25A | NM_001789 |
| P21 | 0.79 | 0.637 | 0.970 | CDKN1A | NM_000389 |
| rhoC | 0.61 | 0.451 | 0.815 | RHOC | NM_175744 |

The hazard ratios derived from the Cox proportional hazards regression model provided in Table 3 provide an assessment of the contribution of the interaction between gene expression measurement and treatment (surgery resection alone versus treatment with 5-FU/LV after surgical resection of tumor) on the instantaneous risk of recurrence at time t conditional on a recurrence not occurring by time t. For an individual with gene expression measurement X, the instantaneous risk of recurrence at time t, $\lambda(t|X)$ is given by the relationship $\lambda(t|X)=\lambda_o(t)\cdot\exp[\beta 1\cdot X+\beta 2\cdot I(Treatment)+\beta 3\cdot I(Treatment)\cdot X]$ where $\lambda_o(t)$ is the baseline hazard at time t, $\beta 3$ is the log hazard ratio from Table 3, and I(Treatment) is an indicator variable for treatment (0=surgical resection and 1=5-FU/LV after surgical resection of tumor ). Again, the survivor function at time t is given by $S(t|X)=S_o(t)^{exp[\beta 1\cdot X+\beta 2\cdot(Treatment)+\beta 3\cdot I(Treatment)\cdot X]}$, where $=S_o(t)$ is the baseline survivor function at time t. Consequently, the risk of recurrence at time t for a patient with a gene expression measurement of X is given by $1-S(t|X)$. In this way, an individual patient's estimated risk of recurrence may be derived from an observed gene expression measurement.

EXAMPLE 3

A Study to Identify Relationships Between Genomic Tumor Expression Profiles and the Likelihood of Recurrence in Stage II and Stage III Colon Cancer Patients Treated with Resection of the Colon The primary objective of this study was to determine whether there is a significant relationship between the expression of each of 375 test genes identified in Table 4 and clinical outcome in Stage II and Stage III colon cancer patients who receive colon resection (surgery) without chemotherapy.

Study Design

This was an observational study using tissue and outcome data from the Cleveland Clinic Foundation (CCF) surgery database in patients who were diagnosed with Stage II and Stage III colon cancer between the years of 1981 and 2000 and received colon resection surgery at CCF.

Inclusion Criteria

Patients who were diagnosed with Stage II and Stage III colon cancer and had colon resection surgery at the Cleveland Clinic Foundation (CCF) between the years of 1981 and 2000.

Exclusion Criteria

Patients identified under inclusion criteria were excluded from the present study if one or more of the following applied:

No tumor block available from initial diagnosis in the CCF archive.

Insufficient tumor in block as assessed by examination of hematoxylin and eosin (H&E) slide.

Patients who were diagnosed with Stage II and Stage III signet ring type colon cancer (WHO classification).

Insufficient RNA (<700 ng) recovered from tissue sections for RT-PCR analysis.

Of the patients initially identified under inclusion criteria, 765 patient samples were available after application of exclusion criteria and used in the gene expression study disclosed herein. The overall demographic and clinical characteristics of the number of included samples were similar to the original CCF cohort.

Gene Panel

Three-hundred seventy-five genes, including reference genes (ATP5E, CLTC, GPX1, NEDD8, PGK1, UBB), were chosen for expression analysis. These genes are listed in Table 4. For each of the 375 genes, probe and primer sequences are shown in Table A, and target amplicons used for expression analysis are shown in Table B.

EXAMPLE 4

A Study to Identify Relationships Between Tumor Gene Expression Profiles and Likelihood of Recurrence in Stage II and Stage III Colon Cancer Patients Treated with Leucovorin-Modulated Fluorouracil After Resection of the Colon The primary objective of this study was to determine whether there is a significant relationship between the expression of each of 375 test genes identified in Table 4 and clinical outcome in stage II and stage III colon cancer patients who received chemotherapy with leucovorin-modulated fluorouracil after colon resection surgery.

Study Design

This study used tissue and outcome data from National Surgical Adjuvant Breast and Bowel Project (NSABP) Study C06 in Stage II and Stage III patients who received colon resection and postoperative treatment with 5-fluorouracil and leucovorin.

Inclusion Criteria

Enrollment in NSABP Study C-06: "A Clinical Trial Comparing Oral Uracil/Ftorafur (UFT) Plus Leucovorin (LV) with 5-Fluorouracil (5-FU) Plus LV in the Treatment of Patients with Stage II and III Carcinoma of the Colon" and randomization to leucovorin-modulated fluorouracil (LV+5-FU) arm of the study.

Exclusion Criteria

Patients enrolled in NSABP Study C-06 were excluded from the present study if one or more of the following applied:

No tumor block available from initial diagnosis in the NSABP archive.
Insufficient tumor in block as assessed by examination of hematoxylin and eosin (H&E) slide.
Patients who were diagnosed with Stage II and Stage III signet ring type colon cancer (WHO classification).
Insufficient RNA (<700 ng) recovered from tissue sections for RT-PCR analysis.

Of the patients enrolled in NSABP Study C-06, 508 patient samples were available after application of exclusion criteria and used in the gene expression study disclosed herein. The overall demographic and clinical characteristics of the number of included samples were similar to the original NSABP cohort.

Gene Panel

Three-hundred seventy-five genes, including reference genes (ATP5E, CLTC, GPX1, NEDD8, PGK1, UBB), were chosen for expression analysis. These genes are listed in Table 4. For each of the 375 genes, probe and primer sequences are shown in Table A, and target amplicons used for expression analysis are shown in Table B.

TABLE 4

| Name |
| --- |
| ABCB1 |
| ABCC5 |
| ABCC6 |
| ADAMTS12 |
| AKAP12 |
| AKT3 |
| ALCAM |
| AMFR |
| ANGPT2 |
| ANTXR1 |
| ANXA1 |
| ANXA2 |
| ANXA5 |
| APC |
| APG-1 |
| AREG |
| ATP5A1 |
| ATP5E |
| AURKB |
| Axin 2 |
| axin1 |
| B-Catenin |
| BAD |
| Bax |
| BCL2L11 |
| BGN |
| BIK |
| BLMH |
| BRAF |
| BRCA1 |
| BRCA2 |
| BUB1 |
| c-myb (MYB official) |
| c-Src |
| C20 orf1 |
| C20ORF126 |
| C8orf4 |
| Cad17 |
| CALD1 |
| CAPG |
| CASP9 |
| CAV1 |
| CCNA2 |
| CCNB1 |
| CCNE2 |
| CCNE2 variant 1 |
| CCR7 |

TABLE 4-continued

| Name |
| --- |
| CD18 |
| CD24 |
| CD3z |
| CD44E |
| CD44s |
| CD44v6 |
| CD68 |
| CD80 |
| CDC2 |
| CDC20 |
| CDC25C |
| CDC4 |
| CDC42BPA |
| CDC6 |
| CDCA7 v2 |
| CDH1 |
| CDH11 |
| CDH3 |
| Cdx2 |
| CEBPB |
| CENPA |
| CENPF |
| CGB |
| CHFR |
| Chk1 |
| cIAP2 |
| CKS2 |
| Claudin 4 |
| CLDN1 |
| CLDN7 |
| CLIC1 |
| CLTC |
| cMet |
| cMYC |
| COL1A1 |
| COL1A2 |
| CREBBP |
| cripto (TDGF1 official) |
| CRYAB |
| CSEL1 |
| CSF1 |
| CTGF |
| CTHRC1 |
| CTSB |
| CTSL |
| CUL4A |
| CXCL12 |
| CXCR4 |
| CYP1B1 |
| CYP2C8 |
| CYP3A4 |
| CYR61 |
| DAPK1 |
| DHFR |
| DKK1 |
| DLC1 |
| DPYD |
| DR4 |
| DUSP1 |
| DUT |
| E2F1 |
| EFNA1 |
| EFNB2 |
| EFP |
| EGLN3 |
| EGR1 |
| EGR3 |
| EI24 |
| EIF4E |
| EIF4EL3 |
| ELAVL1 |
| EMP1 |
| ENO1 |
| EPAS1 |
| EPHB2 |
| EphB6 |
| EREG |
| ESPL1 |

TABLE 4-continued

| Name |
|---|
| F3 |
| FABP4 |
| FAP |
| FASN |
| FBXO5 |
| FGF18 |
| FGF2 |
| FOS |
| FOXO3A |
| FPGS |
| FST |
| FUT6 |
| FYN |
| FZD1 |
| G-Catenin |
| GADD45B |
| GBP2 |
| GCNT1 |
| GHI BRAF mut4 |
| GHI k-ras mut1 |
| GHI k-ras mut2 |
| GHI k-ras mut3 |
| GIT1 |
| GJA1 |
| GJB2 |
| GPX1 |
| Grb10 |
| GRPR |
| GSK3B |
| GSTp |
| GSTT1 |
| H2AFZ |
| HB-EGF |
| hCRA a |
| HDAC1 |
| HER2 |
| HES6 |
| HIF1A |
| HLA-G |
| HNRPAB |
| HNRPD |
| HoxA5 |
| HOXB13 |
| HOXB7 |
| HRAS |
| HSD17B2 |
| HSPA1A |
| HSPA1B |
| HSPA8 |
| HSPE1 |
| HSPG2 |
| ICAM2 |
| ID3 |
| ID4 |
| IGF1 |
| IGFBP3 |
| IGFBP5 |
| IGFBP7 |
| IL6ST |
| INHBA |
| IRS1 |
| ITGA5 |
| ITGAV |
| ITGB1 |
| ITGB3 |
| ITGB4 |
| K-ras |
| KCNH2 iso a/c |
| Ki-67 |
| KIF22 |
| KIFC1 |
| KLF5 |
| KLF6 |
| KLK10 |
| KLK6 |
| KLRK1 |
| KRT8 |
| LAMA3 |

TABLE 4-continued

| Name |
|---|
| LAMC2 |
| LAT |
| LEF |
| LGALS3 |
| LMNB1 |
| LMYC |
| LOX |
| LOXL2 |
| LRP5 |
| LRP6 |
| MAD1L1 |
| MAD2L1 |
| MADH2 |
| MADH4 |
| MADH7 |
| Maspin |
| MCM2 |
| MCM3 |
| MCM6 |
| MCP1 |
| MGAT5 |
| MMP1 |
| MMP2 |
| MMP7 |
| MMP9 |
| MRP3 |
| MSH2 |
| MSH3 |
| MUC1 |
| MUC2 |
| MYBL2 |
| MYH11 |
| MYLK |
| NAV2 |
| NCAM1 |
| NEDD8 |
| NEK2 |
| NFKBp50 |
| Nkd-1 |
| NME1 |
| NOTCH1 |
| NR4A1 |
| NRP1 |
| NRP2 |
| ODC1 |
| OPN, osteopontin |
| OSMR |
| P14ARF |
| p16-INK4 |
| p21 |
| p53R2 |
| PAI1 |
| PCNA |
| PDGFA |
| PDGFB |
| PDGFC |
| PDGFD |
| PDGFRa |
| PFN2 |
| PGK1 |
| PI3K |
| PKR2 |
| PLK |
| PLK3 |
| PPM1D |
| PRDX2 |
| PRDX4 |
| PRKCA |
| PRKCB1 |
| pS2 |
| PTCH |
| PTEN |
| PTGER3 |
| PTP4A3 v2 |
| PTPRJ |
| RAB32 |
| RAD54L |
| RAF1 |

TABLE 4-continued

| Name |
|---|
| RALBP1 |
| RANBP2 |
| RBX1 |
| RCC1 |
| REG4 |
| RhoB |
| rhoC |
| ROCK1 |
| ROCK2 |
| RPS13 |
| RRM1 |
| RRM2 |
| RUNX1 |
| S100A1 |
| S100A4 |
| S100P |
| SAT |
| SBA2 |
| SEMA4B |
| SFRP2 |
| SFRP4 |
| SGCB |
| SHC1 |
| SI |
| SIAT4A |
| SIM2 |
| SIR2 |
| SKP2 |
| SLC25A3 |
| SLC31A1 |
| SLPI |
| SMARCA3 |
| SNAI2 |
| SNRPF |
| SOD1 |
| SOD2 |
| SOS1 |
| SPARC |
| SPINT2 |
| SPRY1 |
| SPRY2 |
| ST14 |
| STAT5B |
| STC1 |
| STK15 |
| STMY3 |
| SURV |
| TAGLN |
| TCF-1 |
| TERC |
| TFF3 |
| TGFB2 |
| TGFB3 |
| TGFBI |
| TGFBR1 |
| TGFBR2 |
| THBS1 |
| THY1 |
| TIMP1 |
| TIMP2 |
| TIMP3 |
| TK1 |
| TLN1 |
| TMEPAI |
| TMSB10 |
| TMSB4X |
| TOP2A |
| TP |
| TP53BP1 |
| TP53BP2 |
| TRAG3 |
| TRAIL |
| TS |
| TUBA1 |
| TUFM |
| UBB |
| UBE2C |
| UBE2M |

TABLE 4-continued

| Name |
|---|
| UMPS |
| UNC5B |
| Upa |
| UPP1 |
| VCL |
| VCP |
| VDAC2 |
| VEGF |
| VEGF_altsplice1 |
| VEGF_altsplice2 |
| VEGFB |
| VEGFC |
| VIM |
| WIF |
| WISP1 |
| WNT2 |

Experimental Materials and Methods

The expression of 375 cancer-related test genes plus six genes designated for use as reference genes was quantitatively assessed for each patient using TaqMan® RT-PCR, which was performed in singlet with RNA input at 1 nanogram per reaction.

Data Analysis Methods

Reference Normalization

For normalization of extraneous effects, cycle threshold ($C_T$) measurements obtained by RT-PCR were normalized relative to the mean expression of a set of six reference genes. The resulting reference-normalized expression measurements typically range from 0 to 15, where a one unit increase generally reflects a 2-fold increase in RNA quantity.

Comparison of Study Cohort to Original NSABP Study Populations

The distribution of clinical and demographic variables for the current study cohort of evaluable tissue blocks was compared to the original NSABP C-04 study population. There were no clinically meaningful differences in the distributions.

Univariate Analysis

For each of the 375 genes under study, the Cox proportional hazard model was used to examine the relationship between gene expression and recurrence free interval (RFI). The likelihood ratio was used as the test of statistical significance. The method of Benjamini and Hochberg (Benjamini, Y. and Hochberg, Y. (1995). Controlling the false discovery rate: a practical and powerful approach to multiple testing. J. R. Statist. Soc. B 57, 289-300.), as well as resampling and permutation based methods (Tusher V G, Tibshirani R, Chu G (2001) Significance analysis of microarrays applied to the ionizing radiation response. Proc Natl Acad Sci USA, 98:5116-5121; Storey J D, Tibshirani R (2001) Estimating false discovery rates under dependence, with applications to DNA microarrays. Stanford: Stanford University, Department of Statistics; Report No.: Technical Report 2001-28.; Korn E L, Troendle J, McShane L, Simon R (2001) Controlling the number of false discoveries: Application to high-dimensional genomic data. Technical Report 003. 2001. National Cancer Institute.) were applied to the resulting set of p-values to estimate false discovery rates.

Analysis of Combined Study Results (Examples 1-4)

The studies presented in Example 1 and Example 3 identified genes for which a significant association was found between gene expression and recurrence-free interval in colon cancer patients treated solely by surgical resection of tumor. The studies presented in Example 2 (only Stage III patients were analyzed in this analysis of combined study results, 171 patients) and Example 4 identified genes for which a significant association was found between gene expression and recurrence-free interval in colon cancer patients treated with 5-FU/LV (leucovorin-modulated fluorouracil) after surgical resection of tumor. In order to identify genes whose expression is associated specifically with response to 5-FU/LV, a test was performed to evaluate whether the Hazard Ratio associated with gene expression in surgery-only patients is sufficiently different from the Hazard Ratio associated with gene expression in surgery+5-FU/LV to conclude that gene expression is informative regarding response to 5-FU. The results are shown in Table 5, which show Hazard Ratios and 75% Confidence Intervals for association between normalized expression values for a particular gene and the likelihood of response to 5-FU treatment. A gene with interaction HR>1 indicates higher recurrence risk and therefore a decreased likelihood of beneficial response as gene expression increases. A gene with interaction HR<1 indicates lower recurrence risk and therefore increased likelihood of beneficial response as gene expression increases. Results are shown for all genes for which the 75% Confidence Interval for Hazard Ratio does not include HR=1. LCL and UCL indicate the lower confidence limit and the upper confidence limit respectively.

TABLE 5

Hazard Ratios and 75% Confidence Intervals for Prediction of Treatment Response Based on Gene Expression Levels (Interaction of Treatment and Gene Expression)

| N | Gene | Hazard Ratio (HR) | HR 75% LCL | HR 75% UCL | LR P-Value* | Official Symbol | Accession Number |
|---|---|---|---|---|---|---|---|
| 1 | ABCB1 | 1.28 | 1.054 | 1.549 | 0.147 | ABCB1 | NM_000927 |
| 2 | AMFR | 1.33 | 1.099 | 1.608 | 0.085 | AMFR | NM_001144 |
| 3 | ANXA1 | 1.16 | 1.020 | 1.314 | 0.186 | ANXA1 | NM_000700 |
| 4 | APC | 1.26 | 1.048 | 1.515 | 0.150 | APC | NM_000038 |
| 5 | AURKB | 0.75 | 0.623 | 0.913 | 0.086 | AURKB | NM_004217 |
| 6 | Axin 2 | 0.85 | 0.787 | 0.918 | 0.015 | AXIN2 | NM_004655 |
| 7 | B-Catenin | 1.26 | 1.052 | 1.519 | 0.141 | CTNNB1 | NM_001904 |
| 8 | BGN | 1.23 | 1.098 | 1.381 | 0.038 | BGN | NM_001711 |
| 9 | BIK | 0.73 | 0.643 | 0.831 | 0.005 | BIK | NM_001197 |
| 10 | BRAF | 0.81 | 0.674 | 0.968 | 0.173 | BRAF | NM_004333 |
| 11 | BRCA2 | 0.00 | 0.000 | — | 0.012 | BRCA2 | NM_000059 |
| 12 | BUB1 | 0.66 | 0.553 | 0.796 | 0.010 | BUB1 | NM_004336 |
| 13 | C20orf1 | 0.76 | 0.657 | 0.889 | 0.042 | TPX2 | NM_012112 |
| 14 | C20ORF126 | 0.67 | 0.543 | 0.832 | 0.031 | PDRG1 | NM_030815 |
| 15 | CALD1 | 1.15 | 1.007 | 1.315 | 0.227 | CALD1 | NM_004342 |
| 16 | CASP9 | 0.64 | 0.420 | 0.961 | 0.203 | CASP9 | NM_001229 |
| 17 | CCNE2 variant 1 | 0.23 | 0.058 | 0.923 | 0.156 | CCNE2 | NM_057749 |
| 18 | CD44E | 1.35 | 1.106 | 1.656 | 0.085 | CD44E | X55150 |
| 19 | CD44s | 1.52 | 1.301 | 1.775 | 0.002 | CD44S | M59040 |
| 20 | CD44v6 | 1.19 | 1.019 | 1.380 | 0.196 | CD44v6 | AJ251595v6 |
| 21 | CD68 | 1.22 | 1.061 | 1.413 | 0.103 | CD68 | NM_001251 |
| 22 | CDC2 | 0.78 | 0.656 | 0.926 | 0.096 | CDC2 | NM_001786 |
| 23 | CDC4 | 0.35 | 0.187 | 0.650 | 0.041 | FBXW7 | NM_018315 |
| 24 | CDH11 | 1.34 | 1.165 | 1.540 | 0.016 | CDH11 | NM_001797 |
| 25 | CENPA | 0.16 | 0.084 | 0.287 | <.001 | CENPA | NM_001809 |
| 26 | CENPF | 0.77 | 0.658 | 0.892 | 0.045 | CENPF | NM_016343 |
| 27 | CHFR | 1.21 | 1.020 | 1.445 | 0.202 | CHFR | NM_018223 |
| 28 | CLDN1 | 1.23 | 1.102 | 1.368 | 0.029 | CLDN1 | NM_021101 |
| 29 | CLIC1 | 0.58 | 0.431 | 0.780 | 0.034 | CLIC1 | NM_001288 |
| 30 | CLTC | 1.33 | 1.056 | 1.670 | 0.153 | CLTC | NM_004859 |
| 31 | COL1A1 | 1.12 | 1.002 | 1.260 | 0.243 | COL1A1 | NM_000088 |
| 32 | COL1A2 | 1.28 | 1.138 | 1.434 | 0.015 | COL1A2 | NM_000089 |
| 33 | CREBBP | 1.35 | 1.098 | 1.672 | 0.097 | CREBBP | NM_004380 |
| 34 | CTSB | 1.27 | 1.040 | 1.542 | 0.167 | CTSB | NM_001908 |
| 35 | CTSL | 1.15 | 1.004 | 1.317 | 0.235 | CTSL | NM_001912 |
| 36 | CXCL12 | 1.12 | 1.016 | 1.237 | 0.185 | CXCL12 | NM_000609 |
| 37 | CYR61 | 0.87 | 0.778 | 0.981 | 0.180 | CYR61 | NM_001554 |
| 38 | Cdx2 | 0.80 | 0.731 | 0.866 | 0.002 | CDX2 | NM_001265 |
| 39 | Chk1 | 0.75 | 0.579 | 0.971 | 0.196 | CHEK1 | NM_001274 |
| 40 | DLC1 | 0.81 | 0.687 | 0.956 | 0.142 | DLC1 | NM_006094 |
| 41 | DUSP1 | 0.86 | 0.768 | 0.959 | 0.111 | DUSP1 | NM_004417 |
| 42 | E2F1 | 0.46 | 0.233 | 0.914 | 0.197 | E2F1 | NM_005225 |
| 43 | EFNB2 | 1.35 | 1.162 | 1.567 | 0.021 | EFNB2 | NM_004093 |
| 44 | EGR3 | 0.88 | 0.784 | 0.992 | 0.223 | EGR3 | NM_004430 |
| 45 | EI24 | 0.75 | 0.607 | 0.931 | 0.127 | EI24 | NM_004879 |
| 46 | ENO1 | 1.27 | 1.045 | 1.545 | 0.159 | ENO1 | NM_001428 |
| 47 | EPAS1 | 1.38 | 1.146 | 1.663 | 0.047 | EPAS1 | NM_001430 |
| 48 | ESPL1 | 0.70 | 0.539 | 0.920 | 0.126 | ESPL1 | NM_012291 |
| 49 | FBXO5 | 0.16 | 0.050 | 0.535 | 0.054 | FBXO5 | NM_012177 |
| 50 | FGF18 | 3.30 | 1.276 | 8.536 | 0.168 | FGF18 | NM_003862 |
| 51 | FGF2 | 0.40 | 0.238 | 0.673 | 0.032 | FGF2 | NM_002006 |
| 52 | FOS | 0.89 | 0.798 | 0.982 | 0.177 | FOS | NM_005252 |
| 53 | FOXO3A | 1.16 | 1.000 | 1.345 | 0.250 | FOXO3A | NM_001455 |
| 54 | FPGS | 1.29 | 1.040 | 1.591 | 0.174 | FPGS | NM_004957 |
| 55 | FUT6 | 0.85 | 0.750 | 0.962 | 0.132 | FUT6 | NM_000150 |
| 56 | FZD1 | 1.30 | 1.082 | 1.571 | 0.104 | FZD1 | NM_003505 |
| 57 | GJB2 | 1.31 | 1.107 | 1.561 | 0.071 | GJB2 | NM_004004 |

TABLE 5-continued

Hazard Ratios and 75% Confidence Intervals for Prediction of Treatment Response
Based on Gene Expression Levels (Interaction of Treatment and Gene Expression)

| N | Gene | Hazard Ratio (HR) | HR 75% LCL | HR 75% UCL | LR P-Value* | Official Symbol | Accession Number |
|---|---|---|---|---|---|---|---|
| 58 | GPX1 | 1.39 | 1.019 | 1.890 | 0.220 | GPX1 | NM_000581 |
| 59 | GSK3B | 0.83 | 0.695 | 0.985 | 0.213 | GSK3B | NM_002093 |
| 60 | Grb10 | 0.79 | 0.647 | 0.959 | 0.157 | GRB10 | NM_005311 |
| 61 | HES6 | 0.84 | 0.765 | 0.920 | 0.029 | HES6 | NM_018645 |
| 62 | HIF1A | 1.61 | 1.372 | 1.879 | <.001 | HIF1A | NM_001530 |
| 63 | HLA-G | 0.35 | 0.122 | 1.004 | 0.202 | HLA-G | NM_002127 |
| 64 | HNRPAB | 0.79 | 0.648 | 0.966 | 0.179 | HNRPAB | NM_004499 |
| 65 | HNRPD | 1.27 | 1.027 | 1.559 | 0.194 | HNRPD | NM_031370 |
| 66 | HOXB13 | 0.70 | 0.549 | 0.886 | 0.075 | HOXB13 | NM_006361 |
| 67 | HSD17B2 | 1.46 | 1.196 | 1.776 | 0.029 | HSD17B2 | NM_002153 |
| 68 | HSPE1 | 0.77 | 0.663 | 0.905 | 0.064 | HSPE1 | NM_002157 |
| 69 | HoxA5 | 1.27 | 1.010 | 1.592 | 0.230 | HOXA5 | NM_019102 |
| 70 | IGFBP3 | 1.23 | 1.077 | 1.394 | 0.071 | IGFBP3 | NM_000598 |
| 71 | IGFBP5 | 1.16 | 1.027 | 1.314 | 0.160 | IGFBP5 | NM_000599 |
| 72 | IGFBP7 | 1.29 | 1.108 | 1.491 | 0.052 | IGFBP7 | NM_001553 |
| 73 | IL6ST | 1.37 | 1.161 | 1.609 | 0.028 | IL6ST | NM_002184 |
| 74 | ITGA5 | 1.28 | 1.125 | 1.456 | 0.028 | ITGA5 | NM_002205 |
| 75 | KIF22 | 0.60 | 0.468 | 0.770 | 0.016 | KIF22 | NM_007317 |
| 76 | KIFC1 | 0.55 | 0.366 | 0.819 | 0.075 | KIFC1 | NM_002263 |
| 77 | KLF5 | 1.22 | 1.066 | 1.388 | 0.087 | KLF5 | NM_001730 |
| 78 | KLK10 | 1.10 | 1.017 | 1.195 | 0.168 | KLK10 | NM_002776 |
| 79 | KLRK1 | 0.53 | 0.326 | 0.847 | 0.101 | KLRK1 | NM_007360 |
| 80 | KRT8 | 1.21 | 1.043 | 1.399 | 0.137 | KRT8 | NM_002273 |
| 81 | Ki-67 | 0.86 | 0.738 | 0.994 | 0.233 | MKI67 | NM_002417 |
| 82 | LAT | 0.71 | 0.534 | 0.954 | 0.180 | LAT | NM_014387 |
| 83 | LEF | 1.28 | 1.110 | 1.465 | 0.045 | LEF1 | NM_016269 |
| 84 | LMYC | 0.70 | 0.550 | 0.900 | 0.096 | RLF | NM_012421 |
| 85 | LOX | 1.18 | 1.004 | 1.383 | 0.243 | LOX | NM_002317 |
| 86 | MAD2L1 | 0.65 | 0.479 | 0.882 | 0.096 | MAD2L1 | NM_002358 |
| 87 | MADH7 | 1.23 | 1.042 | 1.455 | 0.152 | SMAD7 | NM_005904 |
| 88 | MCM3 | 2.54 | 1.283 | 5.012 | 0.110 | MCM3 | NM_002388 |
| 89 | MCP1 | 1.24 | 1.089 | 1.405 | 0.055 | CCL2 | NM_002982 |
| 90 | MMP1 | 1.35 | 1.150 | 1.587 | 0.032 | MMP1 | NM_002421 |
| 91 | MMP2 | 1.20 | 1.075 | 1.344 | 0.058 | MMP2 | NM_004530 |
| 92 | MSH2 | 0.64 | 0.541 | 0.764 | 0.003 | MSH2 | NM_000251 |
| 93 | MSH3 | 0.50 | 0.317 | 0.794 | 0.080 | MSH3 | NM_002439 |
| 94 | Maspin | 1.19 | 1.073 | 1.315 | 0.052 | SERPINB5 | NM_002639 |
| 95 | NR4A1 | 0.82 | 0.750 | 0.902 | 0.015 | NR4A1 | NM_002135 |
| 96 | NRP1 | 1.83 | 1.400 | 2.379 | 0.008 | NRP1 | NM_003873 |
| 97 | PDGFA | 0.84 | 0.750 | 0.949 | 0.096 | PDGFA | NM_002607 |
| 98 | PDGFC | 1.18 | 1.023 | 1.360 | 0.183 | PDGFC | NM_016205 |
| 99 | PDGFD | 2.57 | 1.263 | 5.210 | 0.139 | PDGFD | NM_025208 |
| 100 | PDGFRa | 1.20 | 1.045 | 1.380 | 0.130 | PDGFRA | NM_006206 |
| 101 | PFN2 | 1.26 | 1.071 | 1.490 | 0.106 | PFN2 | NM_053024 |
| 102 | PKR2 | 1.59 | 1.322 | 1.912 | 0.004 | PKM2 | NM_002654 |
| 103 | PRDX2 | 0.79 | 0.656 | 0.953 | 0.148 | PRDX2 | NM_005809 |
| 104 | RAB32 | 0.75 | 0.580 | 0.962 | 0.183 | RAB32 | NM_006834 |
| 105 | RAD54L | 0.17 | 0.067 | 0.409 | 0.011 | RAD54L | NM_003579 |
| 106 | RANBP2 | 0.59 | 0.473 | 0.728 | 0.004 | RANBP2 | NM_006267 |
| 107 | RCC1 | 0.80 | 0.671 | 0.942 | 0.120 | RCC1 | NM_001269 |
| 108 | ROCK2 | 0.65 | 0.529 | 0.792 | 0.013 | ROCK2 | NM_004850 |
| 109 | RUNX1 | 1.49 | 1.257 | 1.764 | 0.007 | RUNX1 | NM_001754 |
| 110 | RhoB | 0.69 | 0.600 | 0.803 | 0.004 | RHOB | NM_004040 |
| 111 | S100P | 0.84 | 0.769 | 0.922 | 0.029 | S100P | NM_005980 |
| 112 | SAT | 0.83 | 0.693 | 0.993 | 0.232 | SAT | NM_002970 |
| 113 | SEMA4B | 1.37 | 1.199 | 1.576 | 0.007 | SEMA4B | NM_020210 |
| 114 | SIAT4A | 1.18 | 1.027 | 1.354 | 0.172 | ST3GAL1 | NM_003033 |
| 115 | SKP2 | 1.66 | 1.184 | 2.329 | 0.082 | SKP2 | NM_005983 |
| 116 | SOD1 | 0.81 | 0.668 | 0.988 | 0.221 | SOD1 | NM_000454 |
| 117 | SOS1 | 0.51 | 0.251 | 1.028 | 0.232 | SOS1 | NM_005633 |
| 118 | SPARC | 1.30 | 1.141 | 1.489 | 0.022 | SPARC | NM_003118 |
| 119 | SPRY1 | 1.20 | 1.014 | 1.414 | 0.214 | SPRY1 | AK026960 |
| 120 | STK15 | 0.74 | 0.618 | 0.882 | 0.050 | AURKA | NM_003600 |
| 121 | TCF-1 | 0.62 | 0.491 | 0.787 | 0.018 | TCF1 | NM_000545 |
| 122 | THBS1 | 1.19 | 1.049 | 1.339 | 0.110 | THBS1 | NM_003246 |
| 123 | TIMP1 | 1.34 | 1.164 | 1.533 | 0.015 | TIMP1 | NM_003254 |
| 124 | TOP2A | 0.75 | 0.635 | 0.881 | 0.042 | TOP2A | NM_001067 |
| 125 | TP53BP1 | 0.75 | 0.576 | 0.983 | 0.219 | TP53BP1 | NM_005657 |
| 126 | UBE2C | 0.77 | 0.669 | 0.889 | 0.034 | UBE2C | NM_007019 |
| 127 | UPP1 | 3.29 | 1.336 | 8.123 | 0.094 | UPP1 | NM_003364 |
| 128 | VCP | 0.70 | 0.559 | 0.867 | 0.060 | VCP | NM_007126 |
| 129 | VDAC2 | 1.38 | 1.051 | 1.812 | 0.175 | VDAC2 | NM_003375 |
| 130 | cMYC | 0.88 | 0.782 | 0.991 | 0.217 | MYC | NM_002467 |

The hazard ratios derived from the Cox proportional hazards regression model provided in Table 5 provide an assessment of the contribution of the interaction between gene expression measurement and treatment (surgery resection alone versus treatment with 5-FU/LV after surgical resection of tumor) on the instantaneous risk of recurrence at time t conditional on a recurrence not occurring by time t. For an individual with gene expression measurement X, the instantaneous risk of recurrence at time t, $\lambda(t|X)$ is given by the relationship $\lambda(t|X)=\lambda_o(t)\cdot\exp[\beta 1\cdot X+\beta 2\cdot I(\text{Treatment})+\beta 3\cdot I(\text{Treatment})\cdot X]$ where $\lambda_o(t)$ is the baseline hazard at time t, $\beta 3$ is the log hazard ratio from Table 3, and I(Treatment) is an indicator variable for treatment (0=surgical resection and 1=5-FU/LV after surgical resection of tumor ). Again, the survivor function at time t is given by $S(t|X)=S_o(t)^{\exp[\beta 1\cdot X+\beta 2\cdot I(\text{Treatment})+\beta 3\cdot I(\text{Treatment})\cdot X]}$, where $=S_o(t)$ is the baseline survivor function at time t. Consequently, the risk of recurrence at time t for a patient with a gene expression measurement of X is given by $1-S(t|X)$. In this way, an individual patient's estimated risk of recurrence may be derived from an observed gene expression measurement. As an example, the hazard ratio for the TCF by treatment interaction from Table 5 is 0.62, indicating that there is a lower recurrence risk after treatment and therefore increased likelihood of beneficial response as gene expression of TCF increases. In fact, the hazard ratios for TCF, treatment and the TCF by treatment interaction are 0.91, 7.92 and 0.62, respectively. Consequently, assuming a baseline survivor function at 3 years of 0.95, the estimated risk of recurrence at 3 years after surgery resection is approximately $1-0.95^{[ln(0.91)\cdot 5]}=0.063$. In contrast, the estimated risk of recurrence at 3 years after surgery resection plus 5FU is $10.95^{\exp[ln(0.91)\cdot 5+ln(7.92)+ln(0.62)*5]}=0.047$.

EXAMPLE 5

Identification of Gene Co-Expressed with Prognostic and/or Predictive Genes

A co-expression study was conducted to identify genes that exhibit expression level trends in colon cancer cells that directly correlate with those identified above that are predictive of likelihood of a beneficial response to a 5-FU therapy. A set of genes were assayed using standard methods similar to those described above. Gene expression clusters (i.e., genes that exhibited similar expression trends in samples as described above) were identified using pair-wise analysis of correlation based on Pearson correlation coefficients (optionally, Spearman correlation coefficients may be used instead or in addition). (See, e.g., Pearson K. and Lee A., Biometrika 2, 357 (1902); C. Spearman, Amer. J. Psychol 15:72-101 (1904); J. Myers, A. Well, Research Design and Statistical Analysis, p. 508 (2nd Ed., 2003).) The correlation between continuous variables is captured by the product-moment correlation coefficient. In general, a correlation coefficient >0.3 is considered to be statistically significant in a sample size of at least 20. (See, e.g., G. Norman, D. Streiner, Biostatistics: The Bare Essentials, 137-138 (3rd Ed. 2007).)

The results are shown in Table C. The column on the far left of the table shows the gene for which co-expressed genes were identified ("Variable"). The results are provided in two rows for each gene with the top row providing a conventional name for the gene (modified by an underscore and a number indicating the version number of the amplicon design, an internal reference), and bottom row indicating the correlation coefficient for co-expression of that gene with the "Variable" gene. The results are ordered from left to right according to highest to lowest correlation coefficient.

The genes in Table C that are co-expressed with the indicated variable gene can serve are referred to as "co-expressed genes", and can be assayed as a substitute for the indicated variable gene and/or in combination with such variable gene (e.g., to provide an internal control for the assay or increase statistical power) in the methods disclosed herein. Exemplary primers and probes, as well as exemplary amplicons, are provided for these genes in Tables A and B.

TABLE A

| Gene | Accession | Reagt | Sequence | SEQ ID NO |
|---|---|---|---|---|
| A-Catenin | NM_001903.1 | FPr | CGTTCCGATCCTCTATACTGCAT | SEQ ID NO: 1 |
| | | Probe | ATGCCTACAGCACCCTGATGTCGCA | SEQ ID NO: 2 |
| | | RPr | AGGTCCCTGTTGGCCTTATAGG | SEQ ID NO: 3 |
| ABCB1 | NM_000927.2 | FPr | AAACACCACTGGAGCATTGA | SEQ ID NO: 4 |
| | | Probe | CTCGCCAATGATGCTGCTCAAGTT | SEQ ID NO: 5 |
| | | RPr | CAAGCCTGGAACCTATAGCC | SEQ ID NO: 6 |
| ABCC5 | NM_005688.1 | FPr | TGCAGACTGTACCATGCTGA | SEQ ID NO: 7 |
| | | Probe | CTGCACACGGTTCTAGGCTCCG | SEQ ID NO: 8 |
| | | RPr | GGCCAGCACCATAATCCTAT | SEQ ID NO: 9 |
| ABCC6 | NM_001171.2 | FPr | GGATGAACCTCGACCTGC | SEQ ID NO: 10 |
| | | Probe | CCAGATAGCCTCGTCCGAGTGCTC | SEQ ID NO: 11 |
| | | RPr | GAGCTGCACCGTCTCCAG | SEQ ID NO: 12 |
| ACP1 | NM_004300.2 | FPr | GCTACCAAGTCCGTGCTGT | SEQ ID NO: 13 |
| | | Probe | TGATCGACAAATGTTACCCAGACACACA | SEQ ID NO: 14 |
| | | RPr | GAAAACTGCTTCTGCAATGG | SEQ ID NO: 15 |
| ADAM10 | NM_001110.1 | FPr | CCCATCAACTTGTGCCAGTA | SEQ ID NO: 16 |
| | | Probe | TGCCTACTCCACTGCACAGACCCT | SEQ ID NO: 17 |
| | | RPr | GGTGATGGTTCGACCACTG | SEQ ID NO: 18 |
| ADAM17 | NM_003183.3 | FPr | GAAGTGCCAGGAGGCGATTA | SEQ ID NO: 19 |
| | | Probe | TGCTACTTGCAAAGGCGTGTCCTACTGC | SEQ ID NO: 20 |
| | | RPr | CGGGCACTCACTGCTATTACC | SEQ ID NO: 21 |

TABLE A-continued

| Gene | Accession | Reagt | Sequence | SEQ ID NO |
|---|---|---|---|---|
| ADAMTS12 | NM_030955.2 | FPr | GGAGAAGGGTGGAGTGCAG | SEQ ID NO: 22 |
| | | Probe | CGCACAGTCAGAATCCATCTGGGT | SEQ ID NO: 23 |
| | | RPr | CAGGGTCAGGTCTCTGGATG | SEQ ID NO: 24 |
| ADPRT | NM_001618.2 | FPr | TTGACAACCTGCTGGACATC | SEQ ID NO: 25 |
| | | Probe | CCCTGAGCAGACTGTAGGCCACCT | SEQ ID NO: 26 |
| | | RPr | ATGGGATCCTTGCTGCTATC | SEQ ID NO: 27 |
| AGXT | NM_000030.1 | FPr | CTTTTCCCTCCAGTGGCA | SEQ ID NO: 28 |
| | | Probe | CTCCTGGAAACAGTCCACTTGGGC | SEQ ID NO: 29 |
| | | RPr | ATTTGGAAGGCACTGGGTTT | SEQ ID NO: 30 |
| AKAP12 | NM_005100.2 | FPr | TAGAGAGCCCCTGACAATCC | SEQ ID NO: 31 |
| | | Probe | TGGCTCTAGCTCCTGATGAAGCCTC | SEQ ID NO: 32 |
| | | RPr | GGTTGGTCTTGGAAAGAGGA | SEQ ID NO: 33 |
| AKT1 | NM_005163.1 | FPr | CGCTTCTATGGCGCTGAGAT | SEQ ID NO: 34 |
| | | Probe | CAGCCCTGGACTACCTGCACTCGG | SEQ ID NO: 35 |
| | | RPr | TCCCGGTACACCACGTTCTT | SEQ ID NO: 36 |
| AKT2 | NM_001626.2 | FPr | TCCTGCCACCCTTCAAACC | SEQ ID NO: 37 |
| | | Probe | CAGGTCACGTCCGAGGTCGACACA | SEQ ID NO: 38 |
| | | RPr | GGCGGTAAATTCATCATCGAA | SEQ ID NO: 39 |
| AKT3 | NM_005465.1 | FPr | TTGTCTCTGCCTTGGACTATCTACA | SEQ ID NO: 40 |
| | | Probe | TCACGGTACACAATCTTTCCGGA | SEQ ID NO: 41 |
| | | RPr | CCAGCATTAGATTCTCCAACTTGA | SEQ ID NO: 42 |
| AL137428 | AL137428.1 | FPr | CAAGAAGAGGCTCTACCCTGG | SEQ ID NO: 43 |
| | | Probe | ACTGGGAATTTCCAAGGCCACCTT | SEQ ID NO: 44 |
| | | RPr | AAATGAGCTCTGCGATCCTC | SEQ ID NO: 45 |
| ALCAM | NM_001627.1 | FPr | GAGGAATATGGAATCCAAGGG | SEQ ID NO: 46 |
| | | Probe | CCAGTTCCTGCCGTCTGCTCTTCT | SEQ ID NO: 47 |
| | | RPr | GTGGCGGAGATCAAGAGG | SEQ ID NO: 48 |
| ALDH1A1 | NM_000689.1 | FPr | GAAGGAGATAAGGAGGATGTTGACA | SEQ ID NO: 49 |
| | | Probe | AGTGAAGGCCGCAAGACAGGCTTTTC | SEQ ID NO: 50 |
| | | RPr | CGCCACGGAGATCCAATC | SEQ ID NO: 51 |
| ALDOA | NM_000034.2 | FPr | GCCTGTACGTGCCAGCTC | SEQ ID NO: 52 |
| | | Probe | TGCCAGAGCCTCAACTGTCTCTGC | SEQ ID NO: 53 |
| | | RPr | TCATCGGAGCTTGATCTCG | SEQ ID NO: 54 |
| AMFR | NM_001144.2 | FPr | GATGGTTCAGCTCTGCAAGGA | SEQ ID NO: 55 |
| | | Probe | CGATTTGAATATCTTTCCTTCTCGCCCACC | SEQ ID NO: 56 |
| | | RPr | TCGACCGTGGCTGCTCAT | SEQ ID NO: 57 |
| ANGPT2 | NM_001147.1 | FPr | CCGTGAAAGCTGCTCTGTAA | SEQ ID NO: 58 |
| | | Probe | AAGCTGACACAGCCCTCCCAAGTG | SEQ ID NO: 59 |
| | | RPr | TTGCAGTGGGAAGAACAGTC | SEQ ID NO: 60 |
| ANTXR1 | NM_032208.1 | FPr | CTCCAGGTGTACCTCCAACC | SEQ ID NO: 61 |
| | | Probe | AGCCTTCTCCCACAGCTGCCTACA | SEQ ID NO: 62 |
| | | RPr | GAGAAGGCTGGGAGACTCTG | SEQ ID NO: 63 |
| ANXA1 | NM_000700.1 | FPr | GCCCCTATCCTACCTTCAATCC | SEQ ID NO: 64 |
| | | Probe | TCCTCGGATGTCGCTGCCT | SEQ ID NO: 65 |
| | | RPr | CCTTTAACCATTATGGCCTTATGC | SEQ ID NO: 66 |
| ANXA2 | NM_004039.1 | FPr | CAAGACACTAAGGGCGACTACCA | SEQ ID NO: 67 |
| | | Probe | CCACCACACAGGTACAGCAGCGCT | SEQ ID NO: 68 |
| | | RPr | CGTGTCGGGCTTCAGTCAT | SEQ ID NO: 69 |
| ANXA5 | NM_001154.2 | FPr | GCTCAAGCCTGGAAGATGAC | SEQ ID NO: 70 |
| | | Probe | AGTACCCTGAAGTGTCCCCCACCA | SEQ ID NO: 71 |
| | | RPr | AGAACCACCAACATCCGCT | SEQ ID NO: 72 |
| AP-1 (JUN official) | NM_002228.2 | FPr | GACTGCAAAGATGGAAACGA | SEQ ID NO: 73 |
| | | Probe | CTATGACGATGCCCTCAACGCCTC | SEQ ID NO: 74 |
| | | RPr | TAGCCATAAGGTCCGCTCTC | SEQ ID NO: 75 |
| APC | NM_000038.1 | FPr | GGACAGCAGGAATGTGTTTC | SEQ ID NO: 76 |
| | | Probe | CATTGGCTCCCCGTGACCTGTA | SEQ ID NO: 77 |
| | | RPr | ACCCACTCGATTTGTTTCTG | SEQ ID NO: 78 |

TABLE A-continued

| Gene | Accession | Reagt | Sequence | SEQ ID NO |
|---|---|---|---|---|
| APEX-1 | NM_001641.2 | FPr | GATGAAGCCTTTCGCAAGTT | SEQ ID NO: 79 |
| | | Probe | CTTTCGGGAAGCCAGGCCCTT | SEQ ID NO: 80 |
| | | RPr | AGGTCTCCACACAGCACAAG | SEQ ID NO: 81 |
| APG-1 | NM_014278.2 | FPr | ACCCCGGCCTGTATATCAT | SEQ ID NO: 82 |
| | | Probe | CCAATGGCTCGAGTTCTTGATCCC | SEQ ID NO: 83 |
| | | RPr | CTATCTGGCTCTTTGCTGCAT | SEQ ID NO: 84 |
| APN (ANPEP official) | NM_001150.1 | FPr | CCACCTTGGACCAAAGTAAAGC | SEQ ID NO: 85 |
| | | Probe | CTCCCCAACACGCTGAAACCCG | SEQ ID NO: 86 |
| | | RPr | TCTCAGCGTCACCTGGTAGGA | SEQ ID NO: 87 |
| APOC1 | NM_001645.3 | FPr | GGAAACACACTGGAGGACAAG | SEQ ID NO: 88 |
| | | Probe | TCATCAGCCGCATCAAACAGAGTG | SEQ ID NO: 89 |
| | | RPr | CGCATCTTGGCAGAAAGTT | SEQ ID NO: 90 |
| AREG | NM_001657.1 | FPr | TGTGAGTGAAATGCCTTCTAGTAGTGA | SEQ ID NO: 91 |
| | | Probe | CCGTCCTCGGGAGCCGACTATGA | SEQ ID NO: 92 |
| | | RPr | TTGTGGTTCGTTATCATACTCTTCTGA | SEQ ID NO: 93 |
| ARG | NM_005158.2 | FPr | CGCAGTGCAGCTGAGTATCTG | SEQ ID NO: 94 |
| | | Probe | TCGCACCAGGAAGCTGCCATTGA | SEQ ID NO: 95 |
| | | RPr | TGCCCAGGGCTACTCTCACTT | SEQ ID NO: 96 |
| ARHF | NM_019034.2 | FPr | ACTGGCCCACTTAGTCCTCA | SEQ ID NO: 97 |
| | | Probe | CTCCCAACCTGCTGTCCCTCAAG | SEQ ID NO: 98 |
| | | RPr | CTGAACTCCACAGGCTGGTA | SEQ ID NO: 99 |
| ATOH1 | NM_005172.1 | FPr | GCAGCCACCTGCAACTTT | SEQ ID NO: 100 |
| | | Probe | CAGGCGAGAGAGCATCCCGTCTAC | SEQ ID NO: 101 |
| | | RPr | TCCAGGAGGGACAGCTCA | SEQ ID NO: 102 |
| ATP5A1 | NM_004046.3 | FPr | GATGCTGCCACTCAACAACT | SEQ ID NO: 103 |
| | | Probe | AGTTAGACGCACGCCACGACTCAA | SEQ ID NO: 104 |
| | | RPr | TGTCCTTGCTTCAGCAACTC | SEQ ID NO: 105 |
| ATP5E | NM_006886.2 | FPr | CCGCTTTCGCTACAGCAT | SEQ ID NO: 106 |
| | | Probe | TCCAGCCTGTCTCCAGTAGGCCAC | SEQ ID NO: 107 |
| | | RPr | TGGGAGTATCGGATGTAGCTG | SEQ ID NO: 108 |
| AURKB | NM_004217.1 | FPr | AGCTGCAGAAGAGCTGCACAT | SEQ ID NO: 109 |
| | | Probe | TGACGAGCAGCGAACAGCCACG | SEQ ID NO: 110 |
| | | RPr | GCATCTGCCAACTCCTCCAT | SEQ ID NO: 111 |
| Axin 2 | NM_004655.2 | FPr | GGCTATGTCTTTGCACCAGC | SEQ ID NO: 112 |
| | | Probe | ACCAGCGCCAACGACAGTGAGATA | SEQ ID NO: 113 |
| | | RPr | ATCCGTCAGCGCATCACT | SEQ ID NO: 114 |
| axin1 | NM_003502.2 | FPr | CCGTGTGACAGCATCGTT | SEQ ID NO: 115 |
| | | Probe | CGTACTACTTCTGCGGGGAACCCA | SEQ ID NO: 116 |
| | | RPr | CTCACCAGGGTGCGGTAG | SEQ ID NO: 117 |
| B-Catenin | NM_001904.1 | FPr | GGCTCTTGTGCGTACTGTCCTT | SEQ ID NO: 118 |
| | | Probe | AGGCTCAGTGATGTCTTCCCTGTCACCAG | SEQ ID NO: 119 |
| | | RPr | TCAGATGACGAAGAGCACAGATG | SEQ ID NO: 120 |
| BAD | NM_032989.1 | FPr | GGGTCAGGTGCCTCGAGAT | SEQ ID NO: 121 |
| | | Probe | TGGGCCCAGAGCATGTTCCAGATC | SEQ ID NO: 122 |
| | | RPr | CTGCTCACTCGGCTCAAACTC | SEQ ID NO: 123 |
| BAG1 | NM_004323.2 | FPr | CGTTGTCAGCACTTGGAATACAA | SEQ ID NO: 124 |
| | | Probe | CCCAATTAACATGACCCGGCAACCAT | SEQ ID NO: 125 |
| | | RPr | GTTCAACCTCTTCCTGTGGACTGT | SEQ ID NO: 126 |
| BAG2 | NM_004282.2 | FPr | CTAGGGGCAAAAGCATGA | SEQ ID NO: 127 |
| | | Probe | TTCCATGCCAGACAGGAAAAGCA | SEQ ID NO: 128 |
| | | RPr | CTAAATGCCCAAGGTGACTG | SEQ ID NO: 129 |
| BAG3 | NM_004281.2 | FPr | GAAAGTAAGCCAGGCCCAGTT | SEQ ID NO: 130 |
| | | Probe | CAGAACTCCCTCCTGGACACATCCCAA | SEQ ID NO: 131 |
| | | RPr | ACCTCTTTGCGGATCACTTGA | SEQ ID NO: 132 |
| Bak | NM_001188.1 | FPr | CCATTCCCACCATTCTACCT | SEQ ID NO: 133 |
| | | Probe | ACACCCCAGACGTCCTGGCCT | SEQ ID NO: 134 |
| | | RPr | GGGAACATAGACCCACCAAT | SEQ ID NO: 135 |

TABLE A-continued

| Gene | Accession | Reagt | Sequence | SEQ ID NO |
|------|-----------|-------|----------|-----------|
| Bax | NM_004324.1 | FPr | CCGCCGTGGACACAGACT | SEQ ID NO: 136 |
| | | Probe | TGCCACTCGGAAAAGACCTCTCGG | SEQ ID NO: 137 |
| | | RPr | TTGCCGTCAGAAAACATGTCA | SEQ ID NO: 138 |
| BBC3 | NM_014417.1 | FPr | CCTGGAGGGTCCTGTACAAT | SEQ ID NO: 139 |
| | | Probe | CATCATGGGACTCCTGCCCTTACC | SEQ ID NO: 140 |
| | | RPr | CTAATTGGGCTCCATCTCG | SEQ ID NO: 141 |
| BCAS1 | NM_003657.1 | FPr | CCCCGAGACAACGGAGATAA | SEQ ID NO: 142 |
| | | Probe | CTTTCCGTTGGCATCCGCAACAG | SEQ ID NO: 143 |
| | | RPr | CTCGGGTTTGGCCTCTTTC | SEQ ID NO: 144 |
| Bcl2 | NM_000633.1 | FPr | CAGATGGACCTAGTACCCACTGAGA | SEQ ID NO: 145 |
| | | Probe | TTCCACGCCGAAGGACAGCGAT | SEQ ID NO: 146 |
| | | RPr | CCTATGATTTAAGGGCATTTTTCC | SEQ ID NO: 147 |
| BCL2L10 | NM_020396.2 | FPr | GCTGGGATGGCTTTTGTCA | SEQ ID NO: 148 |
| | | Probe | TCTTCAGGACCCCCTTTCCACTGGC | SEQ ID NO: 149 |
| | | RPr | GCCTGGACCAGCTGTTTTCTC | SEQ ID NO: 150 |
| BCL2L11 | NM_138621.1 | FPr | AATTACCAAGCAGCCGAAGA | SEQ ID NO: 151 |
| | | Probe | CCACCCACGAATGGTTATCTTACGACTG | SEQ ID NO: 152 |
| | | RPr | CAGGCGGACAATGTAACGTA | SEQ ID NO: 153 |
| BCL2L12 | NM_138639.1 | FPr | AACCCACCCCTGTCTTGG | SEQ ID NO: 154 |
| | | Probe | TCCGGGTAGCTCTCAAACTCGAGG | SEQ ID NO: 155 |
| | | RPr | CTCAGCTGACGGGAAAGG | SEQ ID NO: 156 |
| Bclx | NM_001191.1 | FPr | CTTTTGTGGAACTCTATGGGAACA | SEQ ID NO: 157 |
| | | Probe | TTCGGCTCTCGGCTGCTGCA | SEQ ID NO: 158 |
| | | RPr | CAGCGGTTGAAGCGTTCCT | SEQ ID NO: 159 |
| BCRP | NM_004827.1 | FPr | TGTACTGGCGAAGAATATTTGGTAAA | SEQ ID NO: 160 |
| | | Probe | CAGGGCATCGATCTCTCACCCTGG | SEQ ID NO: 161 |
| | | RPr | GCCACGTGATTCTTCCACAA | SEQ ID NO: 162 |
| BFGF | NM_007083.1 | FPr | CCAGGAAGAATGCTTAAGATGTGA | SEQ ID NO: 163 |
| | | Probe | TTCGCCAGGTCATTGAGATCCATCCA | SEQ ID NO: 164 |
| | | RPr | TGGTGATGGGAGTTGTATTTTCAG | SEQ ID NO: 165 |
| BGN | NM_001711.3 | FPr | GAGCTCCGCAAGGATGAC | SEQ ID NO: 166 |
| | | Probe | CAAGGGTCTCCAGCACCTCTACGC | SEQ ID NO: 167 |
| | | RPr | CTTGTTGTTCACCAGGACGA | SEQ ID NO: 168 |
| BID | NM_001196.2 | FPr | GGACTGTGAGGTCAACAACG | SEQ ID NO: 169 |
| | | Probe | TGTGATGCACTCATCCCTGAGGCT | SEQ ID NO: 170 |
| | | RPr | GGAAGCCAAACACCAGTAGG | SEQ ID NO: 171 |
| BIK | NM_001197.3 | FPr | ATTCCTATGGCTCTGCAATTGTC | SEQ ID NO: 172 |
| | | Probe | CCGGTTAACTGTGGCCTGTGCCC | SEQ ID NO: 173 |
| | | RPr | GGCAGGAGTGAATGGCTCTTC | SEQ ID NO: 174 |
| BIN1 | NM_004305.1 | FPr | CCTGCAAAAGGGAACAAGAG | SEQ ID NO: 175 |
| | | Probe | CTTCGCCTCCAGATGGCTCCC | SEQ ID NO: 176 |
| | | RPr | CGTGGTTGACTCTGATCTCG | SEQ ID NO: 177 |
| BLMH | NM_000386.2 | FPr | GGTTGCTGCCTCCATCAAAG | SEQ ID NO: 178 |
| | | Probe | ACATCACAGCCAAACCACACAGCCTCT | SEQ ID NO: 179 |
| | | RPr | CCAGCTTGCTATTGAAGTGTTTTC | SEQ ID NO: 180 |
| BMP2 | NM_001200.1 | FPr | ATGTGGACGCTCTTTCAATG | SEQ ID NO: 181 |
| | | Probe | ACCGCAGTCCGTCTAAGAAGCACG | SEQ ID NO: 182 |
| | | RPr | ACCATGGTCGACCTTTAGGA | SEQ ID NO: 183 |
| BMP4 | NM_001202.2 | FPr | GGGCTAGCCATTGAGGTG | SEQ ID NO: 184 |
| | | Probe | CTCACCTCCATCAGACTCGGACCC | SEQ ID NO: 185 |
| | | RPr | GCTAATCCTGACATGCTGGC | SEQ ID NO: 186 |
| BMP7 | NM_001719.1 | FPr | TCGTGGAACATGACAAGGAATT | SEQ ID NO: 187 |
| | | Probe | TTCCACCCACGCTACCACCATCG | SEQ ID NO: 188 |
| | | RPr | TGGAAAGATCAAACCGGAACTC | SEQ ID NO: 189 |
| BMPR1A | NM_004329.2 | FPr | TTGGTTCAGCGAACTATTGC | SEQ ID NO: 190 |
| | | Probe | CAAACAGATTCAGATGGTCCGGCA | SEQ ID NO: 191 |
| | | RPr | TCTCCATATCGGCCTTTACC | SEQ ID NO: 192 |

TABLE A-continued

| Gene | Accession | Reagt | Sequence | SEQ ID NO |
|---|---|---|---|---|
| BRAF | NM_004333.1 | FPr | CCTTCCGACCAGCAGATGAA | SEQ ID NO: 193 |
| | | Probe | CAATTTGGGCAACGAGACCGATCCT | SEQ ID NO: 194 |
| | | RPr | TTTATATGCACATTGGGAGCTGAT | SEQ ID NO: 195 |
| BRCA1 | NM_007295.1 | FPr | TCAGGGGGCTAGAAATCTGT | SEQ ID NO: 196 |
| | | Probe | CTATGGGCCCTTCACCAACATGC | SEQ ID NO: 197 |
| | | RPr | CCATTCCAGTTGATCTGTGG | SEQ ID NO: 198 |
| BRCA2 | NM_000059.1 | FPr | AGTTCGTGCTTTGCAAGATG | SEQ ID NO: 199 |
| | | Probe | CATTCTTCACTGCTTCATAAAGCTCTGCA | SEQ ID NO: 200 |
| | | RPr | AAGGTAAGCTGGGTCTGCTG | SEQ ID NO: 201 |
| BRK | NM_005975.1 | FPr | GTGCAGGAAAGGTTCACAAA | SEQ ID NO: 202 |
| | | Probe | AGTGTCTGCGTCCAATACACGCGT | SEQ ID NO: 203 |
| | | RPr | GCACACACGATGGAGTAAGG | SEQ ID NO: 204 |
| BTF3 | NM_001207.2 | FPr | CAGTGATCCACTTTAACAACCCTAAAG | SEQ ID NO: 205 |
| | | Probe | TCAGGCATCTCTGGCAGCGAACAC | SEQ ID NO: 206 |
| | | RPr | AGCATGGCCTGTAATGGTGAA | SEQ ID NO: 207 |
| BTRC | NM_033637.2 | FPr | GTTGGGACACAGTTGGTCTG | SEQ ID NO: 208 |
| | | Probe | CAGTCGGCCCAGGACGGTCTACT | SEQ ID NO: 209 |
| | | RPr | TGAAGCAGTCAGTTGTGCTG | SEQ ID NO: 210 |
| BUB1 | NM_004336.1 | FPr | CCGAGGTTAATCCAGCACGTA | SEQ ID NO: 211 |
| | | Probe | TGCTGGGAGCCTACACTTGGCCC | SEQ ID NO: 212 |
| | | RPr | AAGACATGGCGCTCTCAGTTC | SEQ ID NO: 213 |
| BUB1B | NM_001211.3 | FPr | TCAACAGAAGGCTGAACCACTAGA | SEQ ID NO: 214 |
| | | Probe | TACAGTCCCAGCACCGACAATTCC | SEQ ID NO: 215 |
| | | RPr | CAACAGAGTTTGCCGAGACACT | SEQ ID NO: 216 |
| BUB3 | NM_004725.1 | FPr | CTGAAGCAGATGGTTCATCATT | SEQ ID NO: 217 |
| | | Probe | CCTCGCTTTGTTTAACAGCCCAGG | SEQ ID NO: 218 |
| | | RPr | GCTGATTCCCAAGAGTCTAACC | SEQ ID NO: 219 |
| c-abl | NM_005157.2 | FPr | CCATCTCGCTGAGATACGAA | SEQ ID NO: 220 |
| | | Probe | GGGAGGGTGTACCATTACAGGATCAACA | SEQ ID NO: 221 |
| | | RPr | AGACGTAGAGCTTGCCATCA | SEQ ID NO: 222 |
| c-kit | NM_000222.1 | FPr | GAGGCAACTGCTTATGGCTTAATTA | SEQ ID NO: 223 |
| | | Probe | TTACAGCGACAGTCATGGCCGCAT | SEQ ID NO: 224 |
| | | RPr | GGCACTCGGCTTGAGCAT | SEQ ID NO: 225 |
| c-myb (MYB official) | NM_005375.1 | FPr | AACTCAGACTTGGAAATGCCTTCT | SEQ ID NO: 226 |
| | | Probe | AACTTCCACCCCCCTCATTGGTCACA | SEQ ID NO: 227 |
| | | RPr | CTGGTCTCTATGAAATGGTGTTGTAAC | SEQ ID NO: 228 |
| c-Src | NM_005417.3 | FPr | TGAGGAGTGGTATTTTGGCAAGA | SEQ ID NO: 229 |
| | | Probe | AACCGCTCTGACTCCCGTCTGGTG | SEQ ID NO: 230 |
| | | RPr | CTCTCGGGTTCTCTGCATTGA | SEQ ID NO: 231 |
| C20 orf1 | NM_012112.2 | FPr | TCAGCTGTGAGCTGCGGATA | SEQ ID NO: 232 |
| | | Probe | CAGGTCCCATTGCCGGGCG | SEQ ID NO: 233 |
| | | RPr | ACGGTCCTAGGTTTGAGGTTAAGA | SEQ ID NO: 234 |
| C20ORF126 | NM_030815.2 | FPr | CCAGCACTGCTCGTTACTGT | SEQ ID NO: 235 |
| | | Probe | TGGGACCTCAGACCACTGAAGGC | SEQ ID NO: 236 |
| | | RPr | TTGACTTCACGGCAGTTCATA | SEQ ID NO: 237 |
| C8orf4 | NM_020130.2 | FPr | CTACGAGTCAGCCCATCCAT | SEQ ID NO: 238 |
| | | Probe | CATGGCTACCACTTCGACACAGCC | SEQ ID NO: 239 |
| | | RPr | TGCCCACGGCTTTCTTAC | SEQ ID NO: 240 |
| CA9 | NM_001216.1 | FPr | ATCCTAGCCCTGGTTTTTGG | SEQ ID NO: 241 |
| | | Probe | TTTGCTGTCACCAGCGTCGC | SEQ ID NO: 242 |
| | | RPr | CTGCCTTCTCATCTGCACAA | SEQ ID NO: 243 |
| Cad17 | NM_004063.2 | FPr | GAAGGCCAAGAACCGAGTCA | SEQ ID NO: 244 |
| | | Probe | TTATATTCCAGTTTAAGGCCAATCCTC | SEQ ID NO: 245 |
| | | RPr | TCCCCAGTTAGTTCAAAAGTCACA | SEQ ID NO: 246 |
| CALD1 | NM_004342.4 | FPr | CACTAAGGTTTGAGACAGTTCCAGAA | SEQ ID NO: 247 |
| | | Probe | AACCCAAGCTCAAGACGCAGGACGAG | SEQ ID NO: 248 |
| | | RPr | GCGAATTAGCCCTCTACAACTGA | SEQ ID NO: 249 |

TABLE A-continued

| Gene | Accession | Reagt | Sequence | SEQ ID NO |
|---|---|---|---|---|
| CAPG | NM_001747.1 | FPr | GATTGTCACTGATGGGGAGG | SEQ ID NO: 250 |
| | | Probe | AGGACCTGGATCATCTCAGCAGGC | SEQ ID NO: 251 |
| | | RPr | CCTTCAGAGCAGGCTTGG | SEQ ID NO: 252 |
| CAPN1 | NM_005186.2 | FPr | CAAGAAGCTGTACGAGCTCATCA | SEQ ID NO: 253 |
| | | Probe | CCGCTACTCGGAGCCCGACCTG | SEQ ID NO: 254 |
| | | RPr | GCAGCAAACGAAATTGTCAAAG | SEQ ID NO: 255 |
| CASP8 | NM_033357.1 | FPr | CCTCGGGGATACTGTCTGAT | SEQ ID NO: 256 |
| | | Probe | CAACAATCACAATTTTGCAAAAGCACG | SEQ ID NO: 257 |
| | | RPr | GAAGTTTGGGCACTTTCTCC | SEQ ID NO: 258 |
| CASP9 | NM_001229.2 | FPr | TGAATGCCGTGGATTGCA | SEQ ID NO: 259 |
| | | Probe | CACTAGCCCTGGACCAGCCACTGCT | SEQ ID NO: 260 |
| | | RPr | ACAGGGATCATGGGACACAAG | SEQ ID NO: 261 |
| CAT | NM_001752.1 | FPr | ATCCATTCGATCTCACCAAGGT | SEQ ID NO: 262 |
| | | Probe | TGGCCTCACAAGGACTACCCTCTCATCC | SEQ ID NO: 263 |
| | | RPr | TCCGGTTTAAGACCAGTTTACCA | SEQ ID NO: 264 |
| CAV1 | NM_001753.3 | FPr | GTGGCTCAACATTGTGTTCC | SEQ ID NO: 265 |
| | | Probe | ATTTCAGCTGATCAGTGGGCCTCC | SEQ ID NO: 266 |
| | | RPr | CAATGGCCTCCATTTTACAG | SEQ ID NO: 267 |
| CBL | NM_005188.1 | FPr | TCATTCACAAACCTGGCAGT | SEQ ID NO: 268 |
| | | Probe | TTCCGGCTGAGCTGTACTCGTCTG | SEQ ID NO: 269 |
| | | RPr | CATACCCAATAGCCCACTGA | SEQ ID NO: 270 |
| CCL20 | NM_004591.1 | FPr | CCATGTGCTGTACCAAGAGTTTG | SEQ ID NO: 271 |
| | | Probe | CAGCACTGACATCAAAGCAGCCAGGA | SEQ ID NO: 272 |
| | | RPr | CGCCGCAGAGGTGGAGTA | SEQ ID NO: 273 |
| CCL3 | NM_002983.1 | FPr | AGCAGACAGTGGTCAGTCCTT | SEQ ID NO: 274 |
| | | Probe | CTCTGCTGACACTCGAGCCCACAT | SEQ ID NO: 275 |
| | | RPr | CTGCATGATTCTGAGCAGGT | SEQ ID NO: 276 |
| CCNA2 | NM_001237.2 | FPr | CCATACCTCAAGTATTTGCCATCAG | SEQ ID NO: 277 |
| | | Probe | ATTGCTGGAGCTGCCTTTCATTTAGCACT | SEQ ID NO: 278 |
| | | RPr | AGCTTTGTCCCGTGACTGTGTA | SEQ ID NO: 279 |
| CCNB1 | NM_031966.1 | FPr | TTCAGGTTGTTGCAGGAGAC | SEQ ID NO: 280 |
| | | Probe | TGTCTCCATTATTGATCGGTTCATGCA | SEQ ID NO: 281 |
| | | RPr | CATCTTCTTGGGCACACAAT | SEQ ID NO: 282 |
| CCNB2 | NM_004701.2 | FPr | AGGCTTCTGCAGGAGACTCTGT | SEQ ID NO: 283 |
| | | Probe | TCGATCCATAATGCCAACGCACATG | SEQ ID NO: 284 |
| | | RPr | GGGAAACTGGCTGAACCTGTAA | SEQ ID NO: 285 |
| CCND1 | NM_001758.1 | FPr | GCATGTTCGTGGCCTCTAAGA | SEQ ID NO: 286 |
| | | Probe | AAGGAGACCATCCCCCTGACGG | SEQ ID NO: 287 |
| | | RPr | CGGTGTAGATGCACAGCTTCTC | SEQ ID NO: 288 |
| CCND3 | NM_001760.2 | FPr | CCTCTGTGCTACAGATTATACCTTTGC | SEQ ID NO: 289 |
| | | Probe | TACCCGCCATCCATGATCGCCA | SEQ ID NO: 290 |
| | | RPr | CACTGCAGCCCCAATGCT | SEQ ID NO: 291 |
| CCNE1 | NM_001238.1 | FPr | AAAGAAGATGATGACCGGGTTTAC | SEQ ID NO: 292 |
| | | Probe | CAAACTCAACGTGCAAGCCTCGGA | SEQ ID NO: 293 |
| | | RPr | GAGCCTCTGGATGGTGCAAT | SEQ ID NO: 294 |
| CCNE2 | NM_057749.1 | FPr | GGTCACCAAGAAACATCAGTATGAA | SEQ ID NO: 295 |
| | | Probe | CCCAGATAATACAGGTGGCCAACAATTCCT | SEQ ID NO: 296 |
| | | RPr | TTCAATGATAATGCAAGGACTGATC | SEQ ID NO: 297 |
| CCNE2 variant 1 | NM_057749var1 | FPr | ATGCTGTGGCTCCTTCCTAACT | SEQ ID NO: 298 |
| | | Probe | TACCAAGCAACCTACATGTCAAGAAAGCCC | SEQ ID NO: 299 |
| | | RPr | ACCCAAATTGTGATATACAAAAAGGTT | SEQ ID NO: 300 |
| CCR7 | NM_001838.2 | FPr | GGATGACATGCACTCAGCTC | SEQ ID NO: 301 |
| | | Probe | CTCCCATCCCAGTGGAGCCAA | SEQ ID NO: 302 |
| | | RPr | CCTGACATTTCCCTTGTCCT | SEQ ID NO: 303 |
| CD105 | NM_000118.1 | FPr | GCAGGTGTCAGCAAGTATGATCAG | SEQ ID NO: 304 |
| | | Probe | CGACAGGATATTGACCACCGCCTCATT | SEQ ID NO: 305 |

TABLE A-continued

| Gene | Accession | Reagt | Sequence | SEQ ID NO |
|---|---|---|---|---|
| | | RPr | TTTTTCCGCTGTGGTGATGA | SEQ ID NO: 306 |
| CD134 (TNFRSF4 official) | NM_003327.1 | FPr<br>Probe<br>RPr | GCCCAGTGCGGAGAACAG<br>CCAGCTTGATTCTCGTCTCTGCACTTAAGC<br>AATCACACGCACCTGGAGAAC | SEQ ID NO: 307<br>SEQ ID NO: 308<br>SEQ ID NO: 309 |
| CD18 | NM_000211.1 | FPr<br>Probe<br>RPr | CGTCAGGACCCACCATGTCT<br>CGCGGCCGAGACATGGCTTG<br>GGTTAATTGGTGACATCCTCAAGA | SEQ ID NO: 310<br>SEQ ID NO: 311<br>SEQ ID NO: 312 |
| CD24 | NM_013230.1 | FPr<br>Probe<br>RPr | TCCAACTAATGCCACCACCAA<br>CTGTTGACTGCAGGGCACCACCA<br>GAGAGAGTGAGACCACGAAGAGACT | SEQ ID NO: 313<br>SEQ ID NO: 314<br>SEQ ID NO: 315 |
| CD28 | NM_006139.1 | FPr<br>Probe<br>RPr | TGTGAAAGGGAAACACCTTTG<br>CCAAGTCCCCTATTTCCCGGACCT<br>AGCACCCAAAAGGGCTTAG | SEQ ID NO: 316<br>SEQ ID NO: 317<br>SEQ ID NO: 318 |
| CD31 | NM_000442.1 | FPr<br>Probe<br>RPr | TGTATTTCAAGACCTCTGTGCACTT<br>TTTATGAACCTGCCCTGCTCCCACA<br>TTAGCCTGAGGAATTGCTGTGTT | SEQ ID NO: 319<br>SEQ ID NO: 320<br>SEQ ID NO: 321 |
| CD34 | NM_001773.1 | FPr<br>Probe<br>RPr | CCACTGCACACACCTCAGA<br>CTGTTCTTGGGGCCCTACACCTTG<br>CAGGAGTTTACCTGCCCCT | SEQ ID NO: 322<br>SEQ ID NO: 323<br>SEQ ID NO: 324 |
| CD3z | NM_000734.1 | FPr<br>Probe<br>RPr | AGATGAAGTGGAAGGCGCTT<br>CACCGCGGCCATCCTGCA<br>TGCCTCTGTAATCGGCAACTG | SEQ ID NO: 325<br>SEQ ID NO: 326<br>SEQ ID NO: 327 |
| CD44E | X55150 | FPr<br>Probe<br>RPr | ATCACCGACAGCACAGACA<br>CCCTGCTACCAATATGGACTCCAGTCA<br>ACCTGTGTTTGGATTTGCAG | SEQ ID NO: 328<br>SEQ ID NO: 329<br>SEQ ID NO: 330 |
| CD44s | M59040.1 | FPr<br>Probe<br>RPr | GACGAAGACAGTCCCTGGAT<br>CACCGACAGCACAGACAGAATCCC<br>ACTGGGGTGGAATGTGTCTT | SEQ ID NO: 331<br>SEQ ID NO: 332<br>SEQ ID NO: 333 |
| CD44v3 | AJ251595v3 | FPr<br>Probe<br>RPr | CACACAAAACAGAACCAGGACT<br>ACCCAGTGGAACCCAAGCCATTC<br>CTGAAGTAGCACTTCCGGATT | SEQ ID NO: 334<br>SEQ ID NO: 335<br>SEQ ID NO: 336 |
| CD44v6 | AJ251595v6 | FPr<br>Probe<br>RPr | CTCATACCAGCCATCCAATG<br>CACCAAGCCCAGAGGACAGTTCCT<br>TTGGGTTGAAGAAAATCAGTCC | SEQ ID NO: 337<br>SEQ ID NO: 338<br>SEQ ID NO: 339 |
| CD68 | NM_001251.1 | FPr<br>Probe<br>RPr | TGGTTCCCAGCCCTGTGT<br>CTCCAAGCCCAGATTCAGATTCGAGTCA<br>CTCCTCCACCCTGGGTTGT | SEQ ID NO: 340<br>SEQ ID NO: 341<br>SEQ ID NO: 342 |
| CD80 | NM_005191.2 | FPr<br>Probe<br>RPr | TTCAGTTGCTTTGCAGGAAG<br>TTCTGTGCCCACCATATTCCTCTAGACA<br>TTGATCAAGGTCACCAGAGC | SEQ ID NO: 343<br>SEQ ID NO: 344<br>SEQ ID NO: 345 |
| CD82 | NM_002231.2 | FPr<br>Probe<br>RPr | GTGCAGGCTCAGGTGAAGTG<br>TCAGCTTCTACAACTGGACAGACAACGCTG<br>GACCTCAGGGCGATTCATGA | SEQ ID NO: 346<br>SEQ ID NO: 347<br>SEQ ID NO: 348 |
| CD8A | NM_171827.1 | FPr<br>Probe<br>RPr | AGGGTGAGGTGCTTGAGTCT<br>CCAACGGCAAGGGAACAAGTACTTCT<br>GGGCACAGTATCCCAGGTA | SEQ ID NO: 349<br>SEQ ID NO: 350<br>SEQ ID NO: 351 |
| CD9 | NM_001769.1 | FPr<br>Probe<br>RPr | GGGCGTGGAACAGTTTATCT<br>AGACATCTGCCCCAAGAAGGACGT<br>CACGGTGAAGGTTTCGAGT | SEQ ID NO: 352<br>SEQ ID NO: 353<br>SEQ ID NO: 354 |
| CDC2 | NM_001786.2 | FPr<br>Probe<br>RPr | GAGAGCGACGCGGTTGTT<br>TAGCTGCCGCTGCGGCCG<br>GTATGGTAGATCCCGGCTTATTATTC | SEQ ID NO: 355<br>SEQ ID NO: 356<br>SEQ ID NO: 357 |
| CDC20 | NM_001255.1 | FPr<br>Probe<br>RPr | TGGATTGGAGTTCTGGGAATG<br>ACTGGCCGTGGCACTGGAACA<br>GCTTGCACTCCACAGGTACACA | SEQ ID NO: 358<br>SEQ ID NO: 359<br>SEQ ID NO: 360 |
| cdc25A | NM_001789.1 | FPr<br>Probe<br>RPr | TCTTGCTGGCTACGCCTCTT<br>TGTCCCTGTTAGACGTCCTCCGTCCATA<br>CTGCATTGTGGCACAGTTCTG | SEQ ID NO: 361<br>SEQ ID NO: 362<br>SEQ ID NO: 363 |

TABLE A-continued

| Gene | Accession | Reagt | Sequence | SEQ ID NO |
|---|---|---|---|---|
| CDC25B | NM_021874.1 | FPr | AAACGAGCAGTTTGCCATCAG | SEQ ID NO: 364 |
| | | Probe | CCTCACCGGCATAGACTGGAAGCG | SEQ ID NO: 365 |
| | | RPr | GTTGGTGATGTTCCGAAGCA | SEQ ID NO: 366 |
| CDC25C | NM_001790.2 | FPr | GGTGAGCAGAAGTGGCCTAT | SEQ ID NO: 367 |
| | | Probe | CTCCCCGTCGATGCCAGAGAACT | SEQ ID NO: 368 |
| | | RPr | CTTCAGTCTTGGCCTGTTCA | SEQ ID NO: 369 |
| CDC4 | NM_018315.2 | FPr | GCAGTCCGCTGTGTTCAA | SEQ ID NO: 370 |
| | | Probe | TGCTCCACTAACAACCCTCCTGCC | SEQ ID NO: 371 |
| | | RPr | GGATCCCACACCTTTACCATAA | SEQ ID NO: 372 |
| CDC42 | NM_001791.2 | FPr | TCCAGAGACTGCTGAAAA | SEQ ID NO: 373 |
| | | Probe | CCCGTGACCTGAAGGCTGTCAAG | SEQ ID NO: 374 |
| | | RPr | TGTGTAAGTGCAGAACAC | SEQ ID NO: 375 |
| CDC42BPA | NM_003607.2 | FPr | GAGCTGAAAGACGCACACTG | SEQ ID NO: 376 |
| | | Probe | AATTCCTGCATGGCCAGTTTCCTC | SEQ ID NO: 377 |
| | | RPr | GCCGCTCATTGATCTCCA | SEQ ID NO: 378 |
| CDC6 | NM_001254.2 | FPr | GCAACACTCCCCATTTACCTC | SEQ ID NO: 379 |
| | | Probe | TTGTTCTCCACCAAAGCAAGGCAA | SEQ ID NO: 380 |
| | | RPr | TGAGGGGGACCATTCTCTTT | SEQ ID NO: 381 |
| CDCA7 v2 | NM_145810.1 | FPr | AAGACCGTGGATGGCTACAT | SEQ ID NO: 382 |
| | | Probe | ATGAAGATGACCTGCCCAGAAGCC | SEQ ID NO: 383 |
| | | RPr | AGGGTCACGGATGATCTGG | SEQ ID NO: 384 |
| CDH1 | NM_004360.2 | FPr | TGAGTGTCCCCCGGTATCTTC | SEQ ID NO: 385 |
| | | Probe | TGCCAATCCCGATGAAATTGGAAATTT | SEQ ID NO: 386 |
| | | RPr | CAGCCGCTTTCAGATTTTCAT | SEQ ID NO: 387 |
| CDH11 | NM_001797.2 | FPr | GTCGGCAGAAGCAGGACT | SEQ ID NO: 388 |
| | | Probe | CCTTCTGCCCATAGTGATCAGCGA | SEQ ID NO: 389 |
| | | RPr | CTACTCATGGGCGGGATG | SEQ ID NO: 390 |
| CDH3 | NM_001793.3 | FPr | ACCCATGTACCGTCCTCG | SEQ ID NO: 391 |
| | | Probe | CCAACCCAGATGAAATCGGCAACT | SEQ ID NO: 392 |
| | | RPr | CCGCCTTCAGGTTCTCAAT | SEQ ID NO: 393 |
| CDK2 | NM_001798.2 | FPr | AATGCTGCACTACGACCCTA | SEQ ID NO: 394 |
| | | Probe | CCTTGGCCGAAATCCGCTTGT | SEQ ID NO: 395 |
| | | RPr | TTGGTCACATCCTGGAAGAA | SEQ ID NO: 396 |
| CDX1 | NM_001804.1 | FPr | AGCAACACCAGCCTCCTG | SEQ ID NO: 397 |
| | | Probe | CACCTCCTCTCCAATGCCTGTGAA | SEQ ID NO: 398 |
| | | RPr | GGGCTATGGCAGAAACTCCT | SEQ ID NO: 399 |
| Cdx2 | NM_001265.2 | FPr | GGGCAGGCAAGGTTTACA | SEQ ID NO: 400 |
| | | Probe | ATCTTAGCTGCCTTTGGCTTCCGC | SEQ ID NO: 401 |
| | | RPr | GTCTTTGGTCAGTCCAGCTTTC | SEQ ID NO: 402 |
| CEACAM1 | NM_001712.2 | FPr | ACTTGCCTGTTCAGAGCACTCA | SEQ ID NO: 403 |
| | | Probe | TCCTTCCCACCCCAGTCCTGTC | SEQ ID NO: 404 |
| | | RPr | TGGCAAATCCGAATTAGAGTGA | SEQ ID NO: 405 |
| CEACAM6 | NM_002483.2 | FPr | CACAGCCTCACTTCTAACCTTCTG | SEQ ID NO: 406 |
| | | Probe | ACCCACCCACCACTGCCAAGCT | SEQ ID NO: 407 |
| | | RPr | TTGAATGGCGTGGATTCAATAG | SEQ ID NO: 408 |
| CEBPB | NM_005194.2 | FPr | GCAACCCACGTGTAACTGTC | SEQ ID NO: 409 |
| | | Probe | CCGGGCCCTGAGTAATCGCTTAA | SEQ ID NO: 410 |
| | | RPr | ACAAGCCCGTAGGAACATCT | SEQ ID NO: 411 |
| CEGP1 | NM_020974.1 | FPr | TGACAATCAGCACACCTGCAT | SEQ ID NO: 412 |
| | | Probe | CAGGCCCTCTTCCGAGCGGT | SEQ ID NO: 413 |
| | | RPr | TGTGACTACAGCCGTGATCCTTA | SEQ ID NO: 414 |
| CENPA | NM_001809.2 | FPr | TAAATTCACTCGTGGTGTGGA | SEQ ID NO: 415 |
| | | Probe | CTTCAATTGGCAAGCCCAGGC | SEQ ID NO: 416 |
| | | RPr | GCCTCTTGTAGGGCCAATAG | SEQ ID NO: 417 |
| CENPE | NM_001813.1 | FPr | GGATGCTGGTGACCTCTTCT | SEQ ID NO: 418 |
| | | Probe | TCCCTCACGTTGCAACAGGAATTAA | SEQ ID NO: 419 |
| | | RPr | GCCAAGGCACCAAGTAACTC | SEQ ID NO: 420 |
| CENPF | NM_016343.2 | FPr | CTCCCGTCAACAGCGTTC | SEQ ID NO: 421 |

TABLE A-continued

| Gene | Accession | Reagt | Sequence | SEQ ID NO |
|---|---|---|---|---|
| | | Probe | ACACTGGACCAGGAGTGCATCCAG | SEQ ID NO: 422 |
| | | RPr | GGGTGAGTCTGGCCTTCA | SEQ ID NO: 423 |
| CES2 | NM_003869.4 | FPr | ACTTTGCGAGAAATGGGAAC | SEQ ID NO: 424 |
| | | Probe | AGTGTGGCAGACCCTCGCCATT | SEQ ID NO: 425 |
| | | RPr | CAGGTATTGCTCCTCCTGGT | SEQ ID NO: 426 |
| CGA (CHGA official) | NM_001275.2 | FPr | CTGAAGGAGCTCCAAGACCT | SEQ ID NO: 427 |
| | | Probe | TGCTGATGTGCCCTCTCCTTGG | SEQ ID NO: 428 |
| | | RPr | CAAAACCGCTGTGTTTCTTC | SEQ ID NO: 429 |
| CGB | NM_000737.2 | FPr | CCACCATAGGCAGAGGCA | SEQ ID NO: 430 |
| | | Probe | ACACCCTACTCCCTGTGCCTCCAG | SEQ ID NO: 431 |
| | | RPr | AGTCGTCGAGTGCTAGGGAC | SEQ ID NO: 432 |
| CHAF1B | NM_005441.1 | FPr | GAGGCCAGTGGTGGAAACAG | SEQ ID NO: 433 |
| | | Probe | AGCTGATGAGTCTGCCCTACCGCCTG | SEQ ID NO: 434 |
| | | RPr | TCCGAGGCCACAGCAAAC | SEQ ID NO: 435 |
| CHD2 | NM_001271.1 | FPr | CTCTGTGCGAGGCTGTCA | SEQ ID NO: 436 |
| | | Probe | ACCCATCTCGGGATCCCTGATACC | SEQ ID NO: 437 |
| | | RPr | GGTAAGGACTGTGGGCTGG | SEQ ID NO: 438 |
| CHFR | NM_018223.1 | FPr | AAGGAAGTGGTCCCTCTGTG | SEQ ID NO: 439 |
| | | Probe | TGAAGTCTCCAGCTTTGCCTCAGC | SEQ ID NO: 440 |
| | | RPr | GACGCAGTCTTTCTGTCTGG | SEQ ID NO: 441 |
| Chk1 | NM_001274.1 | FPr | GATAAATTGGTACAAGGGATCAGCTT | SEQ ID NO: 442 |
| | | Probe | CCAGCCCACATGTCCTGATCATATGC | SEQ ID NO: 443 |
| | | RPr | GGGTGCCAAGTAACTGACTATTCA | SEQ ID NO: 444 |
| Chk2 | NM_007194.1 | FPr | ATGTGGAACCCCCACCTACTT | SEQ ID NO: 445 |
| | | Probe | AGTCCCAACAGAAACAAGAACTTCAGGCG | SEQ ID NO: 446 |
| | | RPr | CAGTCCACAGCACGGTTATACC | SEQ ID NO: 447 |
| CIAP1 | NM_001166.2 | FPr | TGCCTGTGGTGGGAAGCT | SEQ ID NO: 448 |
| | | Probe | TGACATAGCATCATCCTTTGGTTCCCAGTT | SEQ ID NO: 449 |
| | | RPr | GGAAAATGCCTCCGGTGTT | SEQ ID NO: 450 |
| cIAP2 | NM_001165.2 | FPr | GGATATTTCCGTGGCTCTTATTCA | SEQ ID NO: 451 |
| | | Probe | TCTCCATCAAATCCTGTAAACTCCAGAGCA | SEQ ID NO: 452 |
| | | RPr | CTTCTCATCAAGGCAGAAAAATCTT | SEQ ID NO: 453 |
| CKS1B | NM_001826.1 | FPr | GGTCCCTAAAACCCATCTGA | SEQ ID NO: 454 |
| | | Probe | TGAACGCCAAGATTCCTCCATTCA | SEQ ID NO: 455 |
| | | RPr | TAATGGACCCATCCCTGACT | SEQ ID NO: 456 |
| CKS2 | NM_001827.1 | FPr | GGCTGGACGTGGTTTTGTCT | SEQ ID NO: 457 |
| | | Probe | CTGCGCCCGCTCTTCGCG | SEQ ID NO: 458 |
| | | RPr | CGCTGCAGAAAATGAAACGA | SEQ ID NO: 459 |
| Claudin 4 | NM_001305.2 | FPr | GGCTGCTTTGCTGCAACTG | SEQ ID NO: 460 |
| | | Probe | CGCACAGACAAGCCTTACTCCGCC | SEQ ID NO: 461 |
| | | RPr | CAGAGCGGGCAGCAGAATA | SEQ ID NO: 462 |
| CLDN1 | NM_021101.3 | FPr | TCTGGGAGGTGCCCTACTT | SEQ ID NO: 463 |
| | | Probe | TGTTCCTGTCCCCGAAAAACAACC | SEQ ID NO: 464 |
| | | RPr | TGGATAGGGCCTTGGTGTT | SEQ ID NO: 465 |
| CLDN7 | NM_001307.3 | FPr | GGTCTGCCCTAGTCATCCTG | SEQ ID NO: 466 |
| | | Probe | TGCACTGCTCTCCTGTTCCTGTCC | SEQ ID NO: 467 |
| | | RPr | GTACCCAGCCTTGCTCTCAT | SEQ ID NO: 468 |
| CLIC1 | NM_001288.3 | FPr | CGGTACTTGAGCAATGCCTA | SEQ ID NO: 469 |
| | | Probe | CGGGAAGAATTCGCTTCCACCTG | SEQ ID NO: 470 |
| | | RPr | TCGATCTCCTCATCATCTGG | SEQ ID NO: 471 |
| CLTC | NM_004859.1 | FPr | ACCGTATGGACAGCCACAG | SEQ ID NO: 472 |
| | | Probe | TCTCACATGCTGTACCCAAAGCCA | SEQ ID NO: 473 |
| | | RPr | TGACTACAGGATCAGCGCTTC | SEQ ID NO: 474 |
| CLU | NM_001831.1 | FPr | CCCCAGGATACCTACCACTACCT | SEQ ID NO: 475 |
| | | Probe | CCCTTCAGCCTGCCCCACCG | SEQ ID NO: 476 |
| | | RPr | TGCGGGACTTGGGAAAGA | SEQ ID NO: 477 |
| cMet | NM_000245.1 | FPr | GACATTTCCAGTCCTGCAGTCA | SEQ ID NO: 478 |
| | | Probe | TGCCTCTCTGCCCCACCCTTTGT | SEQ ID NO: 479 |

TABLE A-continued

| Gene | Accession | Reagt | Sequence | SEQ ID NO |
|---|---|---|---|---|
| | | RPr | CTCCGATCGCACACATTTGT | SEQ ID NO: 480 |
| cMYC | NM_002467.1 | FPr | TCCCTCCACTCGGAAGGACTA | SEQ ID NO: 481 |
| | | Probe | TCTGACACTGTCCAACTTGACCCTCTT | SEQ ID NO: 482 |
| | | RPr | CGGTTGTTGCTGATCTGTCTCA | SEQ ID NO: 483 |
| CNN | NM_001299.2 | FPr | TCCACCCTCCTGGCTTTG | SEQ ID NO: 484 |
| | | Probe | TCCTTTCGTCTTCGCCATGCTGG | SEQ ID NO: 485 |
| | | RPr | TCACTCCCACGTTCACCTTGT | SEQ ID NO: 486 |
| COL1A1 | NM_000088.2 | FPr | GTGGCCATCCAGCTGACC | SEQ ID NO: 487 |
| | | Probe | TCCTGCGCCTGATGTCCACCG | SEQ ID NO: 488 |
| | | RPr | CAGTGGTAGGTGATGTTCTGGGA | SEQ ID NO: 489 |
| COL1A2 | NM_000089.2 | FPr | CAGCCAAGAACTGGTATAGGAGCT | SEQ ID NO: 490 |
| | | Probe | TCTCCTAGCCAGACGTGTTTCTTGTCCTTG | SEQ ID NO: 491 |
| | | RPr | AAACTGGCTGCCAGCATTG | SEQ ID NO: 492 |
| COPS3 | NM_003653.2 | FPr | ATGCCCAGTGTTCCTGACTT | SEQ ID NO: 493 |
| | | Probe | CGAAACGCTATTCTCACAGGTTCAGC | SEQ ID NO: 494 |
| | | RPr | CTCCCCATTACAAGTGCTGA | SEQ ID NO: 495 |
| COX2 | NM_000963.1 | FPr | TCTGCAGAGTTGGAAGCACTCTA | SEQ ID NO: 496 |
| | | Probe | CAGGATACAGCTCCACAGCATCGATGTC | SEQ ID NO: 497 |
| | | RPr | GCCGAGGCTTTTCTACCAGAA | SEQ ID NO: 498 |
| COX3 | MITO_COX3 | FPr | TCGAGTCTCCCTTCACCATT | SEQ ID NO: 499 |
| | | Probe | CGACGGCATCTACGGCTCAACAT | SEQ ID NO: 500 |
| | | RPr | GACGTGAAGTCCGTGGAAG | SEQ ID NO: 501 |
| CP | NM_000096.1 | FPr | CGTGAGTACACAGATGCCTCC | SEQ ID NO: 502 |
| | | Probe | TCTTCAGGGCCTCTCTCCTTTCGA | SEQ ID NO: 503 |
| | | RPr | CCAGGATGCCAAGATGCT | SEQ ID NO: 504 |
| CRBP | NM_002899.2 | FPr | TGGTCTGCAAGCAAGTATTCAAG | SEQ ID NO: 505 |
| | | Probe | TCTGCTTGGGCCTCACTGCACCT | SEQ ID NO: 506 |
| | | RPr | GCTGATTGGTTGGGACAAGGT | SEQ ID NO: 507 |
| CREBBP | NM_004380.1 | FPr | TGGGAAGCAGCTGTGTACCAT | SEQ ID NO: 508 |
| | | Probe | CCTCGCGATGCTGCCTACTACAGCTATC | SEQ ID NO: 509 |
| | | RPr | GAAACACTTCTCACAGAAATGATACCTATT | SEQ ID NO: 510 |
| CRIP2 | NM_001312.1 | FPr | GTGCTACGCCACCCTGTT | SEQ ID NO: 511 |
| | | Probe | CCGATGTTCACGCCTTTGGGTC | SEQ ID NO: 512 |
| | | RPr | CAGGGGCTTCTCGTAGATGT | SEQ ID NO: 513 |
| cripto (TDGF1 official) | NM_003212.1 | FPr | GGGTCTGTGCCCCATGAC | SEQ ID NO: 514 |
| | | Probe | CCTGGCTGCCCAAGAAGTGTTCCCT | SEQ ID NO: 515 |
| | | RPr | TGACCGTGCCAGCATTTACA | SEQ ID NO: 516 |
| CRK(a) | NM_016823.2 | FPr | CTCCCTAACCTCCAGAATGG | SEQ ID NO: 517 |
| | | Probe | ACTCGCTTCTGGATAACCCTGGCA | SEQ ID NO: 518 |
| | | RPr | TGTCTTGTCGTAGGCATTGG | SEQ ID NO: 519 |
| CRMP1 | NM_001313.1 | FPr | AAGGTTTTTGGATTGCAAGG | SEQ ID NO: 520 |
| | | Probe | ACCGTCATACATGCCCCTGGAAAC | SEQ ID NO: 521 |
| | | RPr | GGGTGTAGCTGGTACCTCGT | SEQ ID NO: 522 |
| CRYAB | NM_001885.1 | FPr | GATGTGATTGAGGTGCATGG | SEQ ID NO: 523 |
| | | Probe | TGTTCATCCTGGCGCTCTTCATGT | SEQ ID NO: 524 |
| | | RPr | GAACTCCCTGGAGATGAAACC | SEQ ID NO: 525 |
| CSEL1 | NM_001316.2 | FPr | TTACGCAGCTCATGCTCTTG | SEQ ID NO: 526 |
| | | Probe | ACGGCTCTTTACTATGCGAGGGCC | SEQ ID NO: 527 |
| | | RPr | GCAGCTGTAAAGAGAGTGGCAT | SEQ ID NO: 528 |
| CSF1 | NM_000757.3 | FPr | TGCAGCGGCTGATTGACA | SEQ ID NO: 529 |
| | | Probe | TCAGATGGAGACCTCGTGCCAAATTACA | SEQ ID NO: 530 |
| | | RPr | CAACTGTTCCTGGTCTACAAACTCA | SEQ ID NO: 531 |
| CSK (SRC) | NM_004383.1 | FPr | CCTGAACATGAAGGAGCTGA | SEQ ID NO: 532 |
| | | Probe | TCCCGATGGTCTGCAGCAGCT | SEQ ID NO: 533 |
| | | RPr | CATCACGTCTCCGAACTCC | SEQ ID NO: 534 |
| CTAG1B | NM_001327.1 | FPr | GCTCTCCATCAGCTCCTGTC | SEQ ID NO: 535 |
| | | Probe | CCACATCAACAGGGAAAGCTGCTG | SEQ ID NO: 536 |
| | | RPr | AACACGGGCAGAAAGCACT | SEQ ID NO: 537 |

TABLE A-continued

| Gene | Accession | Reagt | Sequence | SEQ ID NO |
|---|---|---|---|---|
| CTGF | NM_001901.1 | FPr | GAGTTCAAGTGCCCTGACG | SEQ ID NO: 538 |
| | | Probe | AACATCATGTTCTTCTTCATGACCTCGC | SEQ ID NO: 539 |
| | | RPr | AGTTGTAATGGCAGGCACAG | SEQ ID NO: 540 |
| CTHRC1 | NM_138455.2 | FPr | GCTCACTTCGGCTAAAATGC | SEQ ID NO: 541 |
| | | Probe | ACCAACGCTGACAGCATGCATTTC | SEQ ID NO: 542 |
| | | RPr | TCAGCTCCATTGAATGTGAAA | SEQ ID NO: 543 |
| CTLA4 | NM_005214.2 | FPr | CACTGAGGTCCGGGTGACA | SEQ ID NO: 544 |
| | | Probe | CACCTGGCTGTCAGCCTGCCG | SEQ ID NO: 545 |
| | | RPr | GTAGGTTGCCGCACAGACTTC | SEQ ID NO: 546 |
| CTNNBIP1 | NM_020248.2 | FPr | GTTTTCCAGGTCGGAGACG | SEQ ID NO: 547 |
| | | Probe | CTTTGCAGCTACTGCCTCCGGTCT | SEQ ID NO: 548 |
| | | RPr | AGCATCCAGGGTGTTCCA | SEQ ID NO: 549 |
| CTSB | NM_001908.1 | FPr | GGCCGAGATCTACAAAAACG | SEQ ID NO: 550 |
| | | Probe | CCCCGTGGAGGGAGCTTTCTC | SEQ ID NO: 551 |
| | | RPr | GCAGGAAGTCCGAATACACA | SEQ ID NO: 552 |
| CTSD | NM_001909.1 | FPr | GTACATGATCCCCTGTGAGAAGGT | SEQ ID NO: 553 |
| | | Probe | ACCCTGCCCGCGATCACACTGA | SEQ ID NO: 554 |
| | | RPr | GGGACAGCTTGTAGCCTTTGC | SEQ ID NO: 555 |
| CTSH | NM_004390.1 | FPr | GCAAGTTCCAACCTGGAAAG | SEQ ID NO: 556 |
| | | Probe | TGGCTACATCCTTGACAAAGCCGA | SEQ ID NO: 557 |
| | | RPr | CATCGCTTCCTCGTCATAGA | SEQ ID NO: 558 |
| CTSL | NM_001912.1 | FPr | GGGAGGCTTATCTCACTGAGTGA | SEQ ID NO: 559 |
| | | Probe | TTGAGGCCCAGAGCAGTCTACCAGATTCT | SEQ ID NO: 560 |
| | | RPr | CCATTGCAGCCTTCATTGC | SEQ ID NO: 561 |
| CTSL2 | NM_001333.2 | FPr | TGTCTCACTGAGCGAGCAGAA | SEQ ID NO: 562 |
| | | Probe | CTTGAGGACGCGAACAGTCCACCA | SEQ ID NO: 563 |
| | | RPr | ACCATTGCAGCCCTGATTG | SEQ ID NO: 564 |
| CUL1 | NM_003592.2 | FPr | ATGCCCTGGTAATGTCTGCAT | SEQ ID NO: 565 |
| | | Probe | CAGCCACAAAGCCAGCGTCATTGT | SEQ ID NO: 566 |
| | | RPr | GCGACCACAAGCCTTATCAAG | SEQ ID NO: 567 |
| CUL4A | NM_003589.1 | FPr | AAGCATCTTCCTGTTCTTGGA | SEQ ID NO: 568 |
| | | Probe | TATGTGCTGCAGAACTCCACGCTG | SEQ ID NO: 569 |
| | | RPr | AATCCCATATCCCAGATGGA | SEQ ID NO: 570 |
| CXCL12 | NM_000609.3 | FPr | GAGCTACAGATGCCCATGC | SEQ ID NO: 571 |
| | | Probe | TTCTTCGAAAGCCATGTTGCCAGA | SEQ ID NO: 572 |
| | | RPr | TTTGAGATGCTTGACGTTGG | SEQ ID NO: 573 |
| CXCR4 | NM_003467.1 | FPr | TGACCGCTTCTACCCCAATG | SEQ ID NO: 574 |
| | | Probe | CTGAAACTGGAACACAACCACCCACAAG | SEQ ID NO: 575 |
| | | RPr | AGGATAAGGCCAACCATGATGT | SEQ ID NO: 576 |
| CYBA | NM_000101.1 | FPr | GGTGCCTACTCCATTGTGG | SEQ ID NO: 577 |
| | | Probe | TACTCCAGCAGGCACACAAACACG | SEQ ID NO: 578 |
| | | RPr | GTGGAGCCCTTCTTCCTCTT | SEQ ID NO: 579 |
| CYP1B1 | NM_000104.2 | FPr | CCAGCTTTGTGCCTGTCACTAT | SEQ ID NO: 580 |
| | | Probe | CTCATGCCACCACTGCCAACACCTC | SEQ ID NO: 581 |
| | | RPr | GGGAATGTGGTAGCCCAAGA | SEQ ID NO: 582 |
| CYP2C8 | NM_000770.2 | FPr | CCGTGTTCAAGAGGAAGCTC | SEQ ID NO: 583 |
| | | Probe | TTTTCTCAACTCCTCCACAAGGCA | SEQ ID NO: 584 |
| | | RPr | AGTGGGATCACAGGGTGAAG | SEQ ID NO: 585 |
| CYP3A4 | NM_017460.3 | FPr | AGAACAAGGACAACATAGATCCTTACATAT | SEQ ID NO: 586 |
| | | Probe | CACACCCTTTGGAAGTGGACCCAGAA | SEQ ID NO: 587 |
| | | RPr | GCAAACCTCATGCCAATGC | SEQ ID NO: 588 |
| CYR61 | NM_001554.3 | FPr | TGCTCATTCTTGAGGAGCAT | SEQ ID NO: 589 |
| | | Probe | CAGCACCCTTGGCAGTTTCGAAAT | SEQ ID NO: 590 |
| | | RPr | GTGGCTGCATTAGTGTCCAT | SEQ ID NO: 591 |
| DAPK1 | NM_004938.1 | FPr | CGCTGACATCATGAATGTTCCT | SEQ ID NO: 592 |
| | | Probe | TCATATCCAAACTCGCCTCCAGCCG | SEQ ID NO: 593 |
| | | RPr | TCTCTTTCAGCAACGATGTGTCTT | SEQ ID NO: 594 |

TABLE A-continued

| Gene | Accession | Reagt | Sequence | SEQ ID NO |
|---|---|---|---|---|
| DCC | NM_005215.1 | FPr | AAATGTCCTCCTCGACTGCT | SEQ ID NO: 595 |
| | | Probe | ATCACTGGAACTCCTCGGTCGGAC | SEQ ID NO: 596 |
| | | RPr | TGAATGCCATCTTTCTTCCA | SEQ ID NO: 597 |
| DCC_exons 18-23 | X76132_18-23 | FPr | GGTCACCGTTGGTGTCATCA | SEQ ID NO: 598 |
| | | Probe | CAGCCACGATGACCACTACCAGCACT | SEQ ID NO: 599 |
| | | RPr | GAGCGTCGGGTGCAAATC | SEQ ID NO: 600 |
| DCC_exons 6-7 | X76132_6-7 | FPr | ATGGAGATGTGGTCATTCCTAGTG | SEQ ID NO: 601 |
| | | Probe | TGCTTCCTCCCACTATCTGAAAATAA | SEQ ID NO: 602 |
| | | RPr | CACCACCCCAAGTATCCGTAAG | SEQ ID NO: 603 |
| DCK | NM_000788.1 | FPr | GCCGCCACAAGACTAAGGAAT | SEQ ID NO: 604 |
| | | Probe | AGCTGCCCGTCTTTCTCAGCCAGC | SEQ ID NO: 605 |
| | | RPr | CGATGTTCCCTTCGATGGAG | SEQ ID NO: 606 |
| DDB1 | NM_001923.2 | FPr | TGCGGATCATCCGGAATG | SEQ ID NO: 607 |
| | | Probe | AATTGGAATCCACGAGCATGCCAGC | SEQ ID NO: 608 |
| | | RPr | TCCTTTGATGCCTGGTAAGTCA | SEQ ID NO: 609 |
| DET1 | NM_017996.2 | FPr | CTTGTGGAGATCACCCAATCAG | SEQ ID NO: 610 |
| | | Probe | CTATGCCCGGGACTCGGGCCT | SEQ ID NO: 611 |
| | | RPr | CCCGCCTGGATCTCAAACT | SEQ ID NO: 612 |
| DHFR | NM_000791.2 | FPr | TTGCTATAACTAAGTGCTTCTCCAAGA | SEQ ID NO: 613 |
| | | Probe | CCCAACTGAGTCCCCAGCACCT | SEQ ID NO: 614 |
| | | RPr | GTGGAATGGCAGCTCACTGTAG | SEQ ID NO: 615 |
| DHPS | NM_013407.1 | FPr | GGGAGAACGGGATCAATAGGAT | SEQ ID NO: 616 |
| | | Probe | CTCATTGGGCACCAGCAGGTTTCC | SEQ ID NO: 617 |
| | | RPr | GCATCAGCCAGTCCTCAAACT | SEQ ID NO: 618 |
| DIABLO | NM_019887.1 | FPr | CACAATGGCGGCTCTGAAG | SEQ ID NO: 619 |
| | | Probe | AAGTTACGCTGCGCGACAGCCAA | SEQ ID NO: 620 |
| | | RPr | ACACAAACACTGTCTGTACCTGAAGA | SEQ ID NO: 621 |
| DIAPH1 | NM_005219.2 | FPr | CAAGCAGTCAAGGAGAACCA | SEQ ID NO: 622 |
| | | Probe | TTCTTCTGTCTCCCGCCGCTTC | SEQ ID NO: 623 |
| | | RPr | AGTTTTGCTCGCCTCATCTT | SEQ ID NO: 624 |
| DICER1 | NM_177438.1 | FPr | TCCAATTCCAGCATCACTGT | SEQ ID NO: 625 |
| | | Probe | AGAAAAGCTGTTTGTCTCCCCAGCA | SEQ ID NO: 626 |
| | | RPr | GGCAGTGAAGGCGATAAAGT | SEQ ID NO: 627 |
| DKK1 | NM_012242.1 | FPr | TGACAACTACCAGCCGTACC | SEQ ID NO: 628 |
| | | Probe | AGTGCCGCACTCCTCGTCCTCT | SEQ ID NO: 629 |
| | | RPr | GGGACTAGCGCAGTACTCATC | SEQ ID NO: 630 |
| DLC1 | NM_006094.3 | FPr | GATTCAGACGAGGATGAGCC | SEQ ID NO: 631 |
| | | Probe | AAAGTCCATTTGCCACTGATGGCA | SEQ ID NO: 632 |
| | | RPr | CACCTCTTGCTGTCCCTTTG | SEQ ID NO: 633 |
| DPYD | NM_000110.2 | FPr | AGGACGCAAGGAGGGTTTG | SEQ ID NO: 634 |
| | | Probe | CAGTGCCTACAGTCTCGAGTCTGCCAGTG | SEQ ID NO: 635 |
| | | RPr | GATGTCCGCCGAGTCCTTACT | SEQ ID NO: 636 |
| DR4 | NM_003844.1 | FPr | TGCACAGAGGGTGTGGGTTAC | SEQ ID NO: 637 |
| | | Probe | CAATGCTTCCAACAATTTGTTTGCTTGCC | SEQ ID NO: 638 |
| | | RPr | TCTTCATCTGATTTACAAGCTGTACATG | SEQ ID NO: 639 |
| DR5 | NM_003842.2 | FPr | CTCTGAGACAGTGCTTCGATGACT | SEQ ID NO: 640 |
| | | Probe | CAGACTTGGTGCCCTTTGACTCC | SEQ ID NO: 641 |
| | | RPr | CCATGAGGCCCAACTTCCT | SEQ ID NO: 642 |
| DRG1 | NM_004147.3 | FPr | CCTGGATCTCCCAGGTATCA | SEQ ID NO: 643 |
| | | Probe | ACCTTTCCCATCCTTGGCACTTC | SEQ ID NO: 644 |
| | | RPr | TGCAATGACTTGACGACCTC | SEQ ID NO: 645 |
| DSP | NM_004415.1 | FPr | TGGCACTACTGCATGATTGACA | SEQ ID NO: 646 |
| | | Probe | CAGGGCCATGACAATCGCCAA | SEQ ID NO: 647 |
| | | RPr | CCTGCCGCATTGTTTTCAG | SEQ ID NO: 648 |
| DTYMK | NM_012145.1 | FPr | AAATCGCTGGGAACAAGTG | SEQ ID NO: 649 |
| | | Probe | CGCCCTGGCTCAACTTTTCCTTAA | SEQ ID NO: 650 |
| | | RPr | AATGCGTATCTGTCCACGAC | SEQ ID NO: 651 |
| DUSP1 | NM_004417.2 | FPr | AGACATCAGCTCCTGGTTCA | SEQ ID NO: 652 |
| | | Probe | CGAGGCCATTGACTTCATAGACTCCA | SEQ ID NO: 653 |

TABLE A-continued

| Gene | Accession | Reagt | Sequence | SEQ ID NO |
|---|---|---|---|---|
| | | RPr | GACAAACACCCTTCCTCCAG | SEQ ID NO: 654 |
| DUSP2 | NM_004418.2 | FPr | TATCCCTGTGGAGGACAACC | SEQ ID NO: 655 |
| | | Probe | CCTCCTGGAACCAGGCACTGATCT | SEQ ID NO: 656 |
| | | RPr | CACCCAGTCAATGAAGCCTA | SEQ ID NO: 657 |
| DUT | NM_001948.2 | FPr | ACACATGGAGTGCTTCTGGA | SEQ ID NO: 658 |
| | | Probe | ATCAGCCCACTTGACCACCCAGTT | SEQ ID NO: 659 |
| | | RPr | CTCTTGCCTGTGCTTCCAC | SEQ ID NO: 660 |
| DYRK1B | NM_004714.1 | FPr | AGCATGACACGGAGATGAAG | SEQ ID NO: 661 |
| | | Probe | CACCTGAAGCGGCACTTCATGTTC | SEQ ID NO: 662 |
| | | RPr | AATACCAGGCACAGGTGGTT | SEQ ID NO: 663 |
| E2F1 | NM_005225.1 | FPr | ACTCCCTCTACCCTTGAGCA | SEQ ID NO: 664 |
| | | Probe | CAGAAGAACAGCTCAGGGACCCCT | SEQ ID NO: 665 |
| | | RPr | CAGGCCTCAGTTCCTTCAGT | SEQ ID NO: 666 |
| EDN1 endothelin | NM_001955.1 | FPr | TGCCACCTGGACATCATTTG | SEQ ID NO: 667 |
| | | Probe | CACTCCCGAGCACGTTGTTCCGT | SEQ ID NO: 668 |
| | | RPr | TGGACCTAGGGCTTCCAAGTC | SEQ ID NO: 669 |
| EFNA1 | NM_004428.2 | FPr | TACATCTCCAAACCCATCCA | SEQ ID NO: 670 |
| | | Probe | CAACCTCAAGCAGCGGTCTTCATG | SEQ ID NO: 671 |
| | | RPr | TTGCCACTGACAGTCACCTT | SEQ ID NO: 672 |
| EFNA3 | NM_004952.3 | FPr | ACTACATCTCCACGCCCACT | SEQ ID NO: 673 |
| | | Probe | CCTCAGACACTTCCAGTGCAGGTTG | SEQ ID NO: 674 |
| | | RPr | CAGCAGACGAACACCTTCAT | SEQ ID NO: 675 |
| EFNB1 | NM_004429.3 | FPr | GGAGCCCGTATCCTGGAG | SEQ ID NO: 676 |
| | | Probe | CCCTCAACCCCAAGTTCCTGAGTG | SEQ ID NO: 677 |
| | | RPr | GGATAGATCACCAAGCCCTTC | SEQ ID NO: 678 |
| EFNB2 | NM_004093.2 | FPr | TGACATTATCATCCCGCTAAGGA | SEQ ID NO: 679 |
| | | Probe | CGGACAGCGTCTTCTGCCCTCACT | SEQ ID NO: 680 |
| | | RPr | GTAGTCCCCGCTGACCTTCTC | SEQ ID NO: 681 |
| EFP | NM_005082.2 | FPr | TTGAACAGAGCCTGACCAAG | SEQ ID NO: 682 |
| | | Probe | TGATGCTTTCTCCAGAAACTCGAACTCA | SEQ ID NO: 683 |
| | | RPr | TGTTGAGATTCCTCGCAGTT | SEQ ID NO: 684 |
| EGFR | NM_005228.1 | FPr | TGTCGATGGACTTCCAGAAC | SEQ ID NO: 685 |
| | | Probe | CACCTGGGCAGCTGCCAA | SEQ ID NO: 686 |
| | | RPr | ATTGGGACAGCTTGGATCA | SEQ ID NO: 687 |
| EGLN1 | NM_022051.1 | FPr | TCAATGGCCGGACGAAAG | SEQ ID NO: 688 |
| | | Probe | CATTGCCCGGATAACAAGCAACCATG | SEQ ID NO: 689 |
| | | RPr | TTTGGATTATCAACATGACGTACATAAC | SEQ ID NO: 690 |
| EGLN3 | NM_022073.2 | FPr | GCTGGTCCTCTACTGCGG | SEQ ID NO: 691 |
| | | Probe | CCGGCTGGGCAAATACTACGTCAA | SEQ ID NO: 692 |
| | | RPr | CCACCATTGCCTTAGACCTC | SEQ ID NO: 693 |
| EGR1 | NM_001964.2 | FPr | GTCCCCGCTGCAGATCTCT | SEQ ID NO: 694 |
| | | Probe | CGGATCCTTTCCTCACTCGCCCA | SEQ ID NO: 695 |
| | | RPr | CTCCAGCTTAGGGTAGTTGTCCAT | SEQ ID NO: 696 |
| EGR3 | NM_004430.2 | FPr | CCATGTGGATGAATGAGGTG | SEQ ID NO: 697 |
| | | Probe | ACCCAGTCTCACCTTCTCCCCACC | SEQ ID NO: 698 |
| | | RPr | TGCCTGAGAAGAGGTGAGGT | SEQ ID NO: 699 |
| EI24 | NM_004879.2 | FPr | AAAGTGGTGAATGCCATTTG | SEQ ID NO: 700 |
| | | Probe | CCTCAAATGCCAGGTCAGCTATATCCTG | SEQ ID NO: 701 |
| | | RPr | GTGAGGCTTCCTCCCTGATA | SEQ ID NO: 702 |
| EIF4E | NM_001968.1 | FPr | GATCTAAGATGGCGACTGTCGAA | SEQ ID NO: 703 |
| | | Probe | ACCACCCCTACTCCTAATCCCCCGACT | SEQ ID NO: 704 |
| | | RPr | TTAGATTCCGTTTTCTCCTCTTCTG | SEQ ID NO: 705 |
| EIF4EL3 | NM_004846.1 | FPr | AAGCCGCGGTTGAATGTG | SEQ ID NO: 706 |
| | | Probe | TGACCCTCTCCCTCTCTGGATGGCA | SEQ ID NO: 707 |
| | | RPr | TGACGCCAGCTTCAATGATG | SEQ ID NO: 708 |
| ELAVL1 | NM_001419.2 | FPr | GACAGGAGGCCTCTATCCTG | SEQ ID NO: 709 |
| | | Probe | CACCCCACCCTCCACCTCAATC | SEQ ID NO: 710 |
| | | RPr | GTGAGGTAGGTCTGGGAAG | SEQ ID NO: 711 |

TABLE A-continued

| Gene | Accession | Reagt | Sequence | SEQ ID NO |
|---|---|---|---|---|
| EMP1 | NM_001423.1 | FPr | GCTAGTACTTTGATGCTCCCTTGAT | SEQ ID NO: 712 |
| | | Probe | CCAGAGAGCCTCCCTGCAGCCA | SEQ ID NO: 713 |
| | | RPr | GAACAGCTGGAGGCCAAGTC | SEQ ID NO: 714 |
| EMR3 | NM_032571.2 | FPr | TGGCCTACCTCTTCACCATC | SEQ ID NO: 715 |
| | | Probe | TCAACAGCCTCCAAGGCTTCTTCA | SEQ ID NO: 716 |
| | | RPr | TGAGGAGGCAGTAGACCAAGA | SEQ ID NO: 717 |
| EMS1 | NM_005231.2 | FPr | GGCAGTGTCACTGAGTCCTTGA | SEQ ID NO: 718 |
| | | Probe | ATCCTCCCCTGCCCCGCG | SEQ ID NO: 719 |
| | | RPr | TGCACTGTGCGTCCCAAT | SEQ ID NO: 720 |
| ENO1 | NM_001428.2 | FPr | CAAGGCCGTGAACGAGAAGT | SEQ ID NO: 721 |
| | | Probe | CTGCAACTGCCTCCTGCTCAAAGTCA | SEQ ID NO: 722 |
| | | RPr | CGGTCACGGAGCCAATCT | SEQ ID NO: 723 |
| EP300 | NM_001429.1 | FPr | AGCCCCAGCAACTACAGTCT | SEQ ID NO: 724 |
| | | Probe | CACTGACATCATGGCTGGCCTTG | SEQ ID NO: 725 |
| | | RPr | TGTTCAAAGGTTGACCATGC | SEQ ID NO: 726 |
| EPAS1 | NM_001430.3 | FPr | AAGCCTTGGAGGGTTTCATTG | SEQ ID NO: 727 |
| | | Probe | TGTCGCCATCTTGGGTCACCACG | SEQ ID NO: 728 |
| | | RPr | TGCTGATGTTTTCTGACAGAAAGAT | SEQ ID NO: 729 |
| EpCAM | NM_002354.1 | FPr | GGGCCCTCCAGAACAATGAT | SEQ ID NO: 730 |
| | | Probe | CCGCTCTCATCGCAGTCAGGATCAT | SEQ ID NO: 731 |
| | | RPr | TGCACTGCTTGGCCTTAAAGA | SEQ ID NO: 732 |
| EPHA2 | NM_004431.2 | FPr | CGCCTGTTCACCAAGATTGAC | SEQ ID NO: 733 |
| | | Probe | TGCGCCCGATGAGATCACCG | SEQ ID NO: 734 |
| | | RPr | GTGGCGTGCCTCGAAGTC | SEQ ID NO: 735 |
| EPHB2 | NM_004442.4 | FPr | CAACCAGGCAGCTCCATC | SEQ ID NO: 736 |
| | | Probe | CACCTGATGCATGATGGACACTGC | SEQ ID NO: 737 |
| | | RPr | GTAATGCTGTCCACGGTGC | SEQ ID NO: 738 |
| EPHB4 | NM_004444.3 | FPr | TGAACGGGGTATCCTCCTTA | SEQ ID NO: 739 |
| | | Probe | CGTCCCATTTGAGCCTGTCAATGT | SEQ ID NO: 740 |
| | | RPr | AGGTACCTCTCGGTCAGTGG | SEQ ID NO: 741 |
| EphB6 | NM_004445.1 | FPr | ACTGGTCCTCCATCGGCT | SEQ ID NO: 742 |
| | | Probe | CCTTGCACCTCAAACCAAAGCTCC | SEQ ID NO: 743 |
| | | RPr | CCAGTGTAGCATGAGTGCTGA | SEQ ID NO: 744 |
| EPM2A | NM_005670.2 | FPr | ACTGTGGCACTTAGGGGAGA | SEQ ID NO: 745 |
| | | Probe | CTGCCTCTGCCCAAAGCAAATGTC | SEQ ID NO: 746 |
| | | RPr | AGTGGAAATGTGTCCTGGCT | SEQ ID NO: 747 |
| ErbB3 | NM_001982.1 | FPr | CGGTTATGTCATGCCAGATACAC | SEQ ID NO: 748 |
| | | Probe | CCTCAAAGGTACTCCTCCTCCCGG | SEQ ID NO: 749 |
| | | RPr | GAACTGAGACCCACTGAAGAAAGG | SEQ ID NO: 750 |
| ERCC1 | NM_001983.1 | FPr | GTCCAGGTGGATGTGAAAGA | SEQ ID NO: 751 |
| | | Probe | CAGCAGGCCCTCAAGGAGCTG | SEQ ID NO: 752 |
| | | RPr | CGGCCAGGATACACATCTTA | SEQ ID NO: 753 |
| ERCC2 | NM_000400.2 | FPr | TGGCCTTCTTCACCAGCTA | SEQ ID NO: 754 |
| | | Probe | AGGCCACGGTGCTCTCCATGTACT | SEQ ID NO: 755 |
| | | RPr | CAAGGATCCCTGCTCATAC | SEQ ID NO: 756 |
| EREG | NM_001432.1 | FPr | ATAACAAAGTGTAGCTCTGACATGAATG | SEQ ID NO: 757 |
| | | Probe | TTGTTTGCATGGACAGTGCATCTATCTGGT | SEQ ID NO: 758 |
| | | RPr | CACACCTGCAGTAGTTTTGACTCA | SEQ ID NO: 759 |
| ERK1 | Z11696.1 | FPr | ACGGATCACAGTGGAGGAAG | SEQ ID NO: 760 |
| | | Probe | CGCTGGCTCACCCCTACCTG | SEQ ID NO: 761 |
| | | RPr | CTCATCCGTCGGGTCATAGT | SEQ ID NO: 762 |
| ERK2 | NM_002745.1 | FPr | AGTTCTTGACCCCTGGTCCT | SEQ ID NO: 763 |
| | | Probe | TCTCCAGCCCGTCTTGGCTT | SEQ ID NO: 764 |
| | | RPr | AAACGGCTCAAAGGAGTCAA | SEQ ID NO: 765 |
| ESPL1 | NM_012291.1 | FPr | ACCCCAGACCGGATCAG | SEQ ID NO: 766 |
| | | Probe | CTGGCCCTCATGTCCCTTCACG | SEQ ID NO: 767 |
| | | RPr | TGTAGGGCAGACTTCCTCAAACA | SEQ ID NO: 768 |
| EstR1 | NM_000125.1 | FPr | CGTGGTGCCCCTCTATGAC | SEQ ID NO: 769 |
| | | Probe | CTGGAGATGCTGGACGCCC | SEQ ID NO: 770 |

TABLE A-continued

| Gene | Accession | Reagt | Sequence | SEQ ID NO |
|---|---|---|---|---|
| | | RPr | GGCTAGTGGGCGCATGTAG | SEQ ID NO: 771 |
| ETV4 | NM_001986.1 | FPr | TCCAGTGCCTATGACCCC | SEQ ID NO: 772 |
| | | Probe | CAGACAAATCGCCATCAAGTCCCC | SEQ ID NO: 773 |
| | | RPr | ACTGTCCAAGGGCACCAG | SEQ ID NO: 774 |
| F3 | NM_001993.2 | FPr | GTGAAGGATGTGAAGCAGACGTA | SEQ ID NO: 775 |
| | | Probe | TGGCACGGGTCTTCTCCTACC | SEQ ID NO: 776 |
| | | RPr | AACCGGTGCTCTCCACATTC | SEQ ID NO: 777 |
| FABP4 | NM_001442.1 | FPr | GCTTTGCCACCAGGAAAGT | SEQ ID NO: 778 |
| | | Probe | CTGGCATGGCCAAACCTAACATGA | SEQ ID NO: 779 |
| | | RPr | CATCCCCATTCACACTGATG | SEQ ID NO: 780 |
| FAP | NM_004460.2 | FPr | CTGACCAGAACCACGGCT | SEQ ID NO: 781 |
| | | Probe | CGGCCTGTCCACGAACCACTTATA | SEQ ID NO: 782 |
| | | RPr | GGAAGTGGGTCATGTGGG | SEQ ID NO: 783 |
| fas | NM_000043.1 | FPr | GGATTGCTCAACAACCATGCT | SEQ ID NO: 784 |
| | | Probe | TCTGGACCCTCCTACCTCTGGTTCTTACGCT | SEQ ID NO: 785 |
| | | RPr | GGCATTAACACTTTTGGACGATAA | SEQ ID NO: 786 |
| fasl | NM_000639.1 | FPr | GCACTTTGGGATTCTTTCCATTAT | SEQ ID NO: 787 |
| | | Probe | ACAACATTCTCGGTGCCTGTAACAAAGAA | SEQ ID NO: 788 |
| | | RPr | GCATGTAAGAAGACCCTCACTGAA | SEQ ID NO: 789 |
| FASN | NM_004104.4 | FPr | GCCTCTTCCTGTTCGACG | SEQ ID NO: 790 |
| | | Probe | TCGCCCACCTACGTACTGGCCTAC | SEQ ID NO: 791 |
| | | RPr | GCTTTGCCCGGTAGCTCT | SEQ ID NO: 792 |
| FBX05 | NM_012177.2 | FPr | GGCTATTCCTCATTTTCTCTACAAAGTG | SEQ ID NO: 793 |
| | | Probe | CCTCCAGGAGGCTACCTTCTTCATGTTCAC | SEQ ID NO: 794 |
| | | RPr | GGATTGTAGACTGTCACCGAAATTC | SEQ ID NO: 795 |
| FBXW7 | NM_033632.1 | FPr | CCCCAGTTTCAACGAGACTT | SEQ ID NO: 796 |
| | | Probe | TCATTGCTCCCTAAAGAGTTGGCACTC | SEQ ID NO: 797 |
| | | RPr | GTTCCAGGAATGAAAGCACA | SEQ ID NO: 798 |
| FDXR | NM_004110.2 | FPr | GAGATGATTCAGTTACCGGGAG | SEQ ID NO: 799 |
| | | Probe | AATCCACAGGATCCAAAATGGGCC | SEQ ID NO: 800 |
| | | RPr | ATCTTGTCCTGGAGACCCAA | SEQ ID NO: 801 |
| FES | NM_002005.2 | FPr | CTCTGCAGGCCTAGGTGC | SEQ ID NO: 802 |
| | | Probe | CTCCTCAGCGGCTCCAGCTCATAT | SEQ ID NO: 803 |
| | | RPr | CCAGGACTGTGAAGAGCTGTC | SEQ ID NO: 804 |
| FGF18 | NM_003862.1 | FPr | CGGTAGTCAAGTCCGGATCAA | SEQ ID NO: 805 |
| | | Probe | CAAGGAGACGGAATTCTACCTGTGC | SEQ ID NO: 806 |
| | | RPr | GCTTGCCTTTGCGGTTCA | SEQ ID NO: 807 |
| FGF2 | NM_002006.2 | FPr | AGATGCAGGAGAGAGGAAGC | SEQ ID NO: 808 |
| | | Probe | CCTGCAGACTGCTTTTTGCCCAAT | SEQ ID NO: 809 |
| | | RPr | GTTTTGCAGCCTTACCCAAT | SEQ ID NO: 810 |
| FGFR1 | NM_023109.1 | FPr | CACGGGACATTCACCACATC | SEQ ID NO: 811 |
| | | Probe | ATAAAAAGACAACCAACGGCCGACTGC | SEQ ID NO: 812 |
| | | RPr | GGGTGCCATCCACTTCACA | SEQ ID NO: 813 |
| FGFR2 isoform 1 | NM_000141.2 | FPr | GAGGGACTGTTGGCATGCA | SEQ ID NO: 814 |
| | | Probe | TCCCAGAGACCAACGTTCAAGCAGTTG | SEQ ID NO: 815 |
| | | RPr | GAGTGAGAATTCGATCCAAGTCTTC | SEQ ID NO: 816 |
| FHIT | NM_002012.1 | FPr | CCAGTGGAGCGCTTCCAT | SEQ ID NO: 817 |
| | | Probe | TCGGCCACTTCATCAGGACGCAG | SEQ ID NO: 818 |
| | | RPr | CTCTCTGGGTCGTCTGAAACAA | SEQ ID NO: 819 |
| FIGF | NM_004469.2 | FPr | GGTTCCAGCTTTCTGTAGCTGT | SEQ ID NO: 820 |
| | | Probe | ATTGGTGGCCACACCACCTCCTTA | SEQ ID NO: 821 |
| | | RPr | GCCGCAGGTTCTAGTTGCT | SEQ ID NO: 822 |
| FLJ12455 | NM_022078.1 | FPr | CCACCAGCATGAAGTTTCG | SEQ ID NO: 823 |
| | | Probe | ACCCCTCACAAAGGCCATGTCTGT | SEQ ID NO: 824 |
| | | RPr | GGCTGTCTGAAGCACAACTG | SEQ ID NO: 825 |
| FLJ20712 | AK000719.1 | FPr | GCCACACAAACATGCTCCT | SEQ ID NO: 826 |
| | | Probe | ATGTCTTTCCCAGCAGCTCTGCCT | SEQ ID NO: 827 |
| | | RPr | GCCACAGGAAACTTCCGA | SEQ ID NO: 828 |

TABLE A-continued

| Gene | Accession | Reagt | Sequence | SEQ ID NO |
|---|---|---|---|---|
| FLT1 | NM_002019.1 | FPr | GGCTCCCGAATCTATCTTTG | SEQ ID NO: 829 |
| | | Probe | CTACAGCACCAAGAGCGACGTGTG | SEQ ID NO: 830 |
| | | RPr | TCCCACAGCAATACTCCGTA | SEQ ID NO: 831 |
| FLT4 | NM_002020.1 | FPr | ACCAAGAAGCTGAGGACCTG | SEQ ID NO: 832 |
| | | Probe | AGCCCGCTGACCATGGAAGATCT | SEQ ID NO: 833 |
| | | RPr | CCTGGAAGCTGTAGCAGACA | SEQ ID NO: 834 |
| FOS | NM_005252.2 | FPr | CGAGCCCTTTGATGACTTCCT | SEQ ID NO: 835 |
| | | Probe | TCCCAGCATCATCCAGGCCCAG | SEQ ID NO: 836 |
| | | RPr | GGAGCGGGCTGTCTCAGA | SEQ ID NO: 837 |
| FOXO3A | NM_001455.1 | FPr | TGAAGTCCAGGACGATGATG | SEQ ID NO: 838 |
| | | Probe | CTCTACAGCAGCTCAGCCAGCCTG | SEQ ID NO: 839 |
| | | RPr | ACGGCTTGCTTACTGAAGGT | SEQ ID NO: 840 |
| FPGS | NM_004957.3 | FPr | CAGCCCTGCCAGTTTGAC | SEQ ID NO: 841 |
| | | Probe | ATGCCGTCTTCTGCCCTAACCTGA | SEQ ID NO: 842 |
| | | RPr | GTTGCCTGTGGATGACACC | SEQ ID NO: 843 |
| FRP1 | NM_003012.2 | FPr | TTGGTACCTGTGGGTTAGCA | SEQ ID NO: 844 |
| | | Probe | TCCCCAGGGTAGAATTCAATCAGAGC | SEQ ID NO: 845 |
| | | RPr | CACATCCAAATGCAAACTGG | SEQ ID NO: 846 |
| FST | NM_006350.2 | FPr | GTAAGTCGGATGAGCCTGTCTGT | SEQ ID NO: 847 |
| | | Probe | CCAGTGACAATGCCACTTATGCCAGC | SEQ ID NO: 848 |
| | | RPr | CAGCTTCCTTCATGGCACACT | SEQ ID NO: 849 |
| Furin | NM_002569.1 | FPr | AAGTCCTCGATACGCACTATAGCA | SEQ ID NO: 850 |
| | | Probe | CCCGGATGGTCTCCACGTCAT | SEQ ID NO: 851 |
| | | RPr | CTGGCATGTGGCACATGAG | SEQ ID NO: 852 |
| FUS | NM_004960.1 | FPr | GGATAATTCAGACAACAACACCATCT | SEQ ID NO: 853 |
| | | Probe | TCAATTGTAACATTCTCACCCAGGCCTTG | SEQ ID NO: 854 |
| | | RPr | TGAAGTAATCAGCCACAGACTCAAT | SEQ ID NO: 855 |
| FUT1 | NM_000148.1 | FPr | CCGTGCTCATTGCTAACCA | SEQ ID NO: 856 |
| | | Probe | TCTGTCCCTGAACTCCCAGAACCA | SEQ ID NO: 857 |
| | | RPr | CTGCCCAAAGCCAGATGTA | SEQ ID NO: 858 |
| FUT3 | NM_000149.1 | FPr | CAGTTCGGTCCAACAGAGAA | SEQ ID NO: 859 |
| | | Probe | AGCAGGCAACCACCATGTCATTTG | SEQ ID NO: 860 |
| | | RPr | TGCGAATTATATCCCGATGA | SEQ ID NO: 861 |
| FUT6 | NM_000150.1 | FPr | CGTGTGTCTCAAGACGATCC | SEQ ID NO: 862 |
| | | Probe | TGTGTACCCTAATGGGTCCCGCTT | SEQ ID NO: 863 |
| | | RPr | GGTCCCTGTGCTGTCTGG | SEQ ID NO: 864 |
| FXYD5 | NM_014164.4 | FPr | AGAGCACCAAAGCAGCTCAT | SEQ ID NO: 865 |
| | | Probe | CACTGATGACACCACGACGCTCTC | SEQ ID NO: 866 |
| | | RPr | GTGCTTGGGGATGGTCTCT | SEQ ID NO: 867 |
| FYN | NM_002037.3 | FPr | GAAGCGCAGATCATGAAGAA | SEQ ID NO: 868 |
| | | Probe | CTGAAGCACGACAAGCTGGTCCAG | SEQ ID NO: 869 |
| | | RPr | CTCCTCAGACACCACTGCAT | SEQ ID NO: 870 |
| FZD1 | NM_003505.1 | FPr | GGTGCACCAGTTCTACCCTC | SEQ ID NO: 871 |
| | | Probe | ACTTGAGCTCAGCGGAACACTGCA | SEQ ID NO: 872 |
| | | RPr | GCGTACATGGAGCACAGGA | SEQ ID NO: 873 |
| FZD2 | NM_001466.2 | FPr | TGGATCCTCACCTGGTCG | SEQ ID NO: 874 |
| | | Probe | TGCGCTTCCACCTTCTTCACTGTC | SEQ ID NO: 875 |
| | | RPr | GCGCTGCATGTCTACCAA | SEQ ID NO: 876 |
| FZD6 | NM_003506.2 | FPr | AATGAGAGAGGTGAAAGCGG | SEQ ID NO: 877 |
| | | Probe | CGGAGCTAGCACCCCAGGTTAAG | SEQ ID NO: 878 |
| | | RPr | AGGTTCACCACAGTCCTGTTC | SEQ ID NO: 879 |
| G-Catenin | NM_002230.1 | FPr | TCAGCAGCAAGGGCATCAT | SEQ ID NO: 880 |
| | | Probe | CGCCCGCAGGCCTCATCCT | SEQ ID NO: 881 |
| | | RPr | GGTGGTTTTCTTGAGCGTGTACT | SEQ ID NO: 882 |
| G1P2 | NM_005101.1 | FPr | CAACGAATTCCAGGTGTCC | SEQ ID NO: 883 |
| | | Probe | CTGAGCAGCTCCATGTCGGTGTC | SEQ ID NO: 884 |
| | | RPr | GATCTGCGCCTTCAGCTC | SEQ ID NO: 885 |
| GADD45 | NM_001924.2 | FPr | GTGCTGGTGACGAATCCA | SEQ ID NO: 886 |
| | | Probe | TTCATCTCAATGGAAGGATCCTGCC | SEQ ID NO: 887 |

TABLE A-continued

| Gene | Accession | Reagt | Sequence | SEQ ID NO |
|---|---|---|---|---|
| | | RPr | CCCGGCAAAAACAAATAAGT | SEQ ID NO: 888 |
| GADD45B | NM_015675.1 | FPr | ACCCTCGACAAGACCACACT | SEQ ID NO: 889 |
| | | Probe | AACTTCAGCCCCAGCTCCCAAGTC | SEQ ID NO: 890 |
| | | RPr | TGGGAGTTCATGGGTACAGA | SEQ ID NO: 891 |
| GADD45G | NM_006705.2 | FPr | CGCGCTGCAGATCCATTT | SEQ ID NO: 892 |
| | | Probe | CGCTGATCCAGGCTTTCTGCTGC | SEQ ID NO: 893 |
| | | RPr | CGCACTATGTCGATGTCGTTCT | SEQ ID NO: 894 |
| GAGE4 | NM_001474.1 | FPr | GGAACAGGGTCACCCACAGA | SEQ ID NO: 895 |
| | | Probe | TCAGGACCATCTTCACACTCACACCCA | SEQ ID NO: 896 |
| | | RPr | GATTTGGCGGGTCCATCTC | SEQ ID NO: 897 |
| GBP1 | NM_002053.1 | FPr | TTGGGAAATATTTGGGCATT | SEQ ID NO: 898 |
| | | Probe | TTGGGACATTGTAGACTTGGCCAGAC | SEQ ID NO: 899 |
| | | RPr | AGAAGCTAGGGTGGTTGTCC | SEQ ID NO: 900 |
| GBP2 | NM_004120.2 | FPr | GCATGGGAACCATCAACCA | SEQ ID NO: 901 |
| | | Probe | CCATGGACCAACTTCACTATGTGACAGAGC | SEQ ID NO: 902 |
| | | RPr | TGAGGAGTTTGCCTTGATTCG | SEQ ID NO: 903 |
| GCLC | NM_001498.1 | FPr | CTGTTGCAGGAAGGCATTGA | SEQ ID NO: 904 |
| | | Probe | CATCTCCTGGCCCAGCATGTT | SEQ ID NO: 905 |
| | | RPr | GTCAGTGGGTCTCTAATAAAGAGATGAG | SEQ ID NO: 906 |
| GCLM | NM_002061.1 | FPr | TGTAGAATCAAACTCTTCATCATCAACTAG | SEQ ID NO: 907 |
| | | Probe | TGCAGTTGACATGGCCTGTTCAGTCC | SEQ ID NO: 908 |
| | | RPr | CACAGAATCCAGCTGTGCAACT | SEQ ID NO: 909 |
| GCNT1 | NM_001490.3 | FPr | TGGTGCTTGGAGCATAGAAG | SEQ ID NO: 910 |
| | | Probe | TGCCCTTCACAAAGGAAATCCCTG | SEQ ID NO: 911 |
| | | RPr | GCAACGTCCTCAGCATTTC | SEQ ID NO: 912 |
| GDF15 | NM_004864.1 | FPr | CGCTCCAGACCTATGATGACT | SEQ ID NO: 913 |
| | | Probe | TGTTAGCCAAAGACTGCCACTGCA | SEQ ID NO: 914 |
| | | RPr | ACAGTGGAAGGACCAGGACT | SEQ ID NO: 915 |
| GIT1 | NM_014030.2 | FPr | GTGTATGACGAGGTGGATCG | SEQ ID NO: 916 |
| | | Probe | AGCCAGCCACACTGCATCATTTTC | SEQ ID NO: 917 |
| | | RPr | ACCAGAGTGCTGTGGTTTTG | SEQ ID NO: 918 |
| GJA1 | NM_000165.2 | FPr | GTTCACTGGGGGTGTATGG | SEQ ID NO: 919 |
| | | Probe | ATCCCCTCCCTCTCCACCCATCTA | SEQ ID NO: 920 |
| | | RPr | AAATACCAACATGCACCTCTCTT | SEQ ID NO: 921 |
| GJB2 | NM_004004.3 | FPr | TGTCATGTACGACGGCTTCT | SEQ ID NO: 922 |
| | | Probe | AGGCGTTGCACTTCACCAGCC | SEQ ID NO: 923 |
| | | RPr | AGTCCACAGTGTTGGGACAA | SEQ ID NO: 924 |
| GPX1 | NM_000581.2 | FPr | GCTTATGACCGACCCCAA | SEQ ID NO: 925 |
| | | Probe | CTCATCACCTGGTCTCCGGTGTGT | SEQ ID NO: 926 |
| | | RPr | AAAGTTCCAGGCAACATCGT | SEQ ID NO: 927 |
| GPX2 | NM_002083.1 | FPr | CACACAGATCTCCTACTCCATCCA | SEQ ID NO: 928 |
| | | Probe | CATGCTGCATCCTAAGGCTCCTCAGG | SEQ ID NO: 929 |
| | | RPr | GGTCCAGCAGTGTCTCCTGAA | SEQ ID NO: 930 |
| Grb10 | NM_005311.2 | FPr | CTTCGCCTTTGCTGATTGC | SEQ ID NO: 931 |
| | | Probe | CTCCAAACGCCTGCCTGACGACTG | SEQ ID NO: 932 |
| | | RPr | CCATAACGCACATGCTCCAA | SEQ ID NO: 933 |
| GRB14 | NM_004490.1 | FPr | TCCCACTGAAGCCCTTTCAG | SEQ ID NO: 934 |
| | | Probe | CCTCCAAGCGAGTCCTTCTTCAACCG | SEQ ID NO: 935 |
| | | RPr | AGTGCCCAGGCGTAAACATC | SEQ ID NO: 936 |
| GRB2 | NM_002086.2 | FPr | GTCCATCAGTGCATGACGTT | SEQ ID NO: 937 |
| | | Probe | AGGCCACGTATAGTCCTAGCTGACGC | SEQ ID NO: 938 |
| | | RPr | AGCCCACTTGGTTTCTTGTT | SEQ ID NO: 939 |
| GRB7 | NM_005310.1 | FPr | CCATCTGCATCCATCTTGTT | SEQ ID NO: 940 |
| | | Probe | CTCCCCACCCTTGAGAAGTGCCT | SEQ ID NO: 941 |
| | | RPr | GGCCACCAGGGTATTATCTG | SEQ ID NO: 942 |
| GRIK1 | NM_000830.2 | FPr | GTTGGGTGCATCTCTCGG | SEQ ID NO: 943 |
| | | Probe | AATTCATGCCGAGATACAGCCGCT | SEQ ID NO: 944 |

TABLE A-continued

| Gene | Accession | Reagt | Sequence | SEQ ID NO |
|---|---|---|---|---|
| | | RPr | CGTGCTCCATCTTCCTAGCTT | SEQ ID NO: 945 |
| GRO1 | NM_001511.1 | FPr | CGAAAAGATGCTGAACAGTGACA | SEQ ID NO: 946 |
| | | Probe | CTTCCTCCTCCCTTCTGGTCAGTTGGAT | SEQ ID NO: 947 |
| | | RPr | TCAGGAACAGCCACCAGTGA | SEQ ID NO: 948 |
| GRP | NM_002091.1 | FPr | CTGGGTCTCATAGAAGCAAAGGA | SEQ ID NO: 949 |
| | | Probe | AGAAACCACCAGCCACCTCAACCCA | SEQ ID NO: 950 |
| | | RPr | CCACGAAGGCTGCTGATTG | SEQ ID NO: 951 |
| GRPR | NM_005314.1 | FPr | ATGCTGCTGGCCATTCCA | SEQ ID NO: 952 |
| | | Probe | CCGTGTTTTCTGACCTCCATCCCTTCC | SEQ ID NO: 953 |
| | | RPr | AGGTCTGGTTGGTGCTTTCCT | SEQ ID NO: 954 |
| GSK3B | NM_002093.2 | FPr | GACAAGGACGGCAGCAAG | SEQ ID NO: 955 |
| | | Probe | CCAGGAGTTGCCACCACTGTTGTC | SEQ ID NO: 956 |
| | | RPr | TTGTGGCCTGTCTGGACC | SEQ ID NO: 957 |
| GSTA3 | NM_000847.3 | FPr | TCTCCAACTTCCCTCTGCTG | SEQ ID NO: 958 |
| | | Probe | AGGCCCTGAAAACCAGAATCAGCA | SEQ ID NO: 959 |
| | | RPr | ACTTCTTCACCGTGGGCA | SEQ ID NO: 960 |
| GSTM1 | NM_000561.1 | FPr | AAGCTATGAGGAAAAGAAGTACACGAT | SEQ ID NO: 961 |
| | | Probe | TCAGCCACTGGCTTCTGTCATAATCAGGAG | SEQ ID NO: 962 |
| | | RPr | GGCCCAGCTTGAATTTTTCA | SEQ ID NO: 963 |
| GSTM3 | NM_000849.3 | FPr | CAATGCCATCTTGCGCTACAT | SEQ ID NO: 964 |
| | | Probe | CTCGCAAGCACAACATGTGTGGTGAGA | SEQ ID NO: 965 |
| | | RPr | GTCCACTCGAATCTTTTCTTCTTCA | SEQ ID NO: 966 |
| GSTp | NM_000852.2 | FPr | GAGACCCTGCTGTCCCAGAA | SEQ ID NO: 967 |
| | | Probe | TCCCACAATGAAGGTCTTGCCTCCT | SEQ ID NO: 968 |
| | | RPr | GGTTGTAGTCAGCGAAGGAGATC | SEQ ID NO: 969 |
| GSTT1 | NM_000853.1 | FPr | CACCATCCCCACCCTGTCT | SEQ ID NO: 970 |
| | | Probe | CACAGCCGCCTGAAAGCCACAAT | SEQ ID NO: 971 |
| | | RPr | GGCCTCAGTGTGCATCATTCT | SEQ ID NO: 972 |
| H2AFZ | NM_002106.2 | FPr | CCGGAAAGGCCAAGACAA | SEQ ID NO: 973 |
| | | Probe | CCCGCTCGCAGAGAGCCGG | SEQ ID NO: 974 |
| | | RPr | AATACGGCCCACTGGGAACT | SEQ ID NO: 975 |
| HB-EGF | NM_001945.1 | FPr | GACTCCTTCGTCCCCAGTTG | SEQ ID NO: 976 |
| | | Probe | TTGGGCCTCCCATAATTGCTTTGCC | SEQ ID NO: 977 |
| | | RPr | TGGCACTTGAAGGCTCTGGTA | SEQ ID NO: 978 |
| hCRA a | U78556.1 | FPr | TGACACCCTTACCTTCCTGAGAA | SEQ ID NO: 979 |
| | | Probe | TCTGCTTTCCGCGCTCCCAGG | SEQ ID NO: 980 |
| | | RPr | AAAAACACGAGTCAAAATAGAAGTCACT | SEQ ID NO: 981 |
| HDAC1 | NM_004964.2 | FPr | CAAGTACCACAGCGATGACTACATTAA | SEQ ID NO: 982 |
| | | Probe | TTCTTGCGCTCCATCCGTCCAGA | SEQ ID NO: 983 |
| | | RPr | GCTTGCTGTACTCCGACATGTT | SEQ ID NO: 984 |
| HDAC2 | NM_001527.1 | FPr | GGTGGCTACACAATCCGTAA | SEQ ID NO: 985 |
| | | Probe | TGCAGTCTCATATGTCCAACATCGAGC | SEQ ID NO: 986 |
| | | RPr | TGGGAATCTCACAATCAAGG | SEQ ID NO: 987 |
| HDGF | NM_004494.1 | FPr | TCCTAGGCATTCTGGACCTC | SEQ ID NO: 988 |
| | | Probe | CATTCCTACCCCTGATCCCAACCC | SEQ ID NO: 989 |
| | | RPr | GCTGTTGATGCTCCATCCTT | SEQ ID NO: 990 |
| hENT1 | NM_004955.1 | FPr | AGCCGTGACTGTTGAGGTC | SEQ ID NO: 991 |
| | | Probe | AAGTCCAGCATCGCAGGCAGC | SEQ ID NO: 992 |
| | | RPr | AAGTAACGTTCCCAGGTGCT | SEQ ID NO: 993 |
| Hepsin | NM_002151.1 | FPr | AGGCTGCTGGAGGTCATCTC | SEQ ID NO: 994 |
| | | Probe | CCAGAGGCCGTTTCTTGGCCG | SEQ ID NO: 995 |
| | | RPr | CTTCCTGCGGCCACAGTCT | SEQ ID NO: 996 |
| HER2 | NM_004448.1 | FPr | CGGTGTGAGAAGTGCAGCAA | SEQ ID NO: 997 |
| | | Probe | CCAGACCATAGCACACTCGGGCAC | SEQ ID NO: 998 |
| | | RPr | CCTCTCGCAAGTGCTCCAT | SEQ ID NO: 999 |
| Herstatin | AF177761.2 | FPr | CACCCTGTCCTATCCTTCCT | SEQ ID NO: 1000 |
| | | Probe | CCCTCTTGGGACCTAGTCTCTGCCT | SEQ ID NO: 1001 |

TABLE A-continued

| Gene | Accession | Reagt | Sequence | SEQ ID NO |
|------|-----------|-------|----------|-----------|
| | | RPr | GGCCAGGGGTAGAGAGTAGA | SEQ ID NO: 1002 |
| HES6 | NM_018645.3 | FPr | TTAGGGACCCTGCAGCTCT | SEQ ID NO: 1003 |
| | | Probe | TAGCTCCTCCCTCCACCCACTC | SEQ ID NO: 1004 |
| | | RPr | CTACAAAATTCTTCCTCCTGCC | SEQ ID NO: 1005 |
| HGF | M29145.1 | FPr | CCGAAATCCAGATGATGATG | SEQ ID NO: 1006 |
| | | Probe | CTCATGGACCCTGGTGCTACACG | SEQ ID NO: 1007 |
| | | RPr | CCCAAGGAATGAGTGGATTT | SEQ ID NO: 1008 |
| HIF1A | NM_001530.1 | FPr | TGAACATAAAGTCTGCAACATGGA | SEQ ID NO: 1009 |
| | | Probe | TTGCACTGCACAGGCCACATTCAC | SEQ ID NO: 1010 |
| | | RPr | TGAGGTTGGTTACTGTTGGTATCATATA | SEQ ID NO: 1011 |
| HK1 | NM_000188.1 | FPr | TACGCACAGAGGCAAGCA | SEQ ID NO: 1012 |
| | | Probe | TAAGAGTCCGGGATCCCCAGCCTA | SEQ ID NO: 1013 |
| | | RPr | GAGAGAAGTGCTGGAGAGGC | SEQ ID NO: 1014 |
| HLA-DPB1 | NM_002121.4 | FPr | TCCATGATGGTTCTGCAGGTT | SEQ ID NO: 1015 |
| | | Probe | CCCCGGACAGTGGCTCTGACG | SEQ ID NO: 1016 |
| | | RPr | TGAGCAGCACCATCAGTAACG | SEQ ID NO: 1017 |
| HLA-DRA | NM_019111.3 | FPr | GACGATTTGCCAGCTTTGAG | SEQ ID NO: 1018 |
| | | Probe | TCAAGGTGCATTGGCCAACATAGC | SEQ ID NO: 1019 |
| | | RPr | TCCAGGTTGGCTTTGTCC | SEQ ID NO: 1020 |
| HLA-DRB1 | NM_002124.1 | FPr | GCTTTCTCAGGACCTGGTTG | SEQ ID NO: 1021 |
| | | Probe | CATTTCTGCAGTTGCCGAACCAG | SEQ ID NO: 1022 |
| | | RPr | AGGAAGCCACAAGGGAGG | SEQ ID NO: 1023 |
| HLA-G | NM_002127.2 | FPr | CCTGCGCGGCTACTACAAC | SEQ ID NO: 1024 |
| | | Probe | CGAGGCCAGTTCTCACACCCTCCAG | SEQ ID NO: 1025 |
| | | RPr | CAGGTCGCAGCCAATCATC | SEQ ID NO: 1026 |
| HMGB1 | NM_002128.3 | FPr | TGGCCTGTCCATTGGTGAT | SEQ ID NO: 1027 |
| | | Probe | TTCCACATCTCTCCCAGTTTCTTCGCAA | SEQ ID NO: 1028 |
| | | RPr | GCTTGTCATCTGCAGCAGTGTT | SEQ ID NO: 1029 |
| hMLH | NM_000249.2 | FPr | CTACTTCCAGCAACCCCAGA | SEQ ID NO: 1030 |
| | | Probe | TCCACATCAGAATCTTCCCG | SEQ ID NO: 1031 |
| | | RPr | CTTTCGGGAATCATCTTCCA | SEQ ID NO: 1032 |
| HNRPAB | NM_004499.2 | FPr | CAAGGGAGCGACCAACTGA | SEQ ID NO: 1033 |
| | | Probe | CTCCATATCCAAACAAAGCATGTGTGCG | SEQ ID NO: 1034 |
| | | RPr | GTTTGCCAAGTTAAATTTGGTACATAAT | SEQ ID NO: 1035 |
| HNRPD | NM_031370.2 | FPr | GCCAGTAAGAACGAGGAGGA | SEQ ID NO: 1036 |
| | | Probe | AAGGCCATTCAAACTCCTCCCCAC | SEQ ID NO: 1037 |
| | | RPr | CGTCGCTGCTTCAGAGTGT | SEQ ID NO: 1038 |
| HoxA1 | NM_005522.3 | FPr | AGTGACAGATGGACAATGCAAGA | SEQ ID NO: 1039 |
| | | Probe | TGAACTCCTTCCTGGAATACCCCA | SEQ ID NO: 1040 |
| | | RPr | CCGAGTCGCCACTGCTAAGT | SEQ ID NO: 1041 |
| HoxA5 | NM_019102.2 | FPr | TCCCTTGTGTTCCTTCTGTGAA | SEQ ID NO: 1042 |
| | | Probe | AGCCCTGTTCTCGTTGCCCTAATTCATC | SEQ ID NO: 1043 |
| | | RPr | GGCAATAAACAGGCTCATGATTAA | SEQ ID NO: 1044 |
| HOXB13 | NM_006361.2 | FPr | CGTGCCTTATGGTTACTTTGG | SEQ ID NO: 1045 |
| | | Probe | ACACTCGGCAGGAGTAGTACCCGC | SEQ ID NO: 1046 |
| | | RPr | CACAGGGTTTCAGCGAGC | SEQ ID NO: 1047 |
| HOXB7 | NM_004502.2 | FPr | CAGCCTCAAGTTCGGTTTTC | SEQ ID NO: 1048 |
| | | Probe | ACCGGAGCCTTCCCAGAACAAACT | SEQ ID NO: 1049 |
| | | RPr | GTTGGAAGCAAACGCACA | SEQ ID NO: 1050 |
| HRAS | NM_005343.2 | FPr | GGACGAATACGACCCCACT | SEQ ID NO: 1051 |
| | | Probe | ACCACCTGCTTCCGGTAGGAATCC | SEQ ID NO: 1052 |
| | | RPr | GCACGTCTCCCATCAAT | SEQ ID NO: 1053 |
| HSBP1 | NM_001537.1 | FPr | GGAGATGGCCGAGACTGAC | SEQ ID NO: 1054 |
| | | Probe | CAAGACCGTGCAGGACCTCACCT | SEQ ID NO: 1055 |
| | | RPr | CTGCAGGAGTGTCTGCACC | SEQ ID NO: 1056 |
| HSD17B1 | NM_000413.1 | FPr | CTGGACCGCACGGACATC | SEQ ID NO: 1057 |
| | | Probe | ACCGCTTCTACCAATACCTCGCCCA | SEQ ID NO: 1058 |
| | | RPr | CGCCTCGCGAAAGACTTG | SEQ ID NO: 1059 |

TABLE A-continued

| Gene | Accession | Reagt | Sequence | SEQ ID NO |
|---|---|---|---|---|
| HSD17B2 | NM_002153.1 | FPr | GCTTTCCAAGTGGGGAATTA | SEQ ID NO: 1060 |
| | | Probe | AGTTGCTTCCATCCAACCTGGAGG | SEQ ID NO: 1061 |
| | | RPr | TGCCTGCGATATTTGTTAGG | SEQ ID NO: 1062 |
| HSPA1A | NM_005345.4 | FPr | CTGCTGCGACAGTCCACTA | SEQ ID NO: 1063 |
| | | Probe | AGAGTGACTCCCGTTGTCCCAAGG | SEQ ID NO: 1064 |
| | | RPr | CAGGTTCGCTCTGGGAAG | SEQ ID NO: 1065 |
| HSPA1B | NM_005346.3 | FPr | GGTCCGCTTCGTCTTTCGA | SEQ ID NO: 1066 |
| | | Probe | TGACTCCCGCGGTCCCAAGG | SEQ ID NO: 1067 |
| | | RPr | GCACAGGTTCGCTCTGGAA | SEQ ID NO: 1068 |
| HSPA4 | NM_002154.3 | FPr | TTCAGTGTGTCCAGTGCATC | SEQ ID NO: 1069 |
| | | Probe | CATTTTCCTCAGACTTGTGAACCTCCACT | SEQ ID NO: 1070 |
| | | RPr | ATCTGTTTCCATTGGCTCCT | SEQ ID NO: 1071 |
| HSPA5 | NM_005347.2 | FPr | GGCTAGTAGAACTGGATCCCAACA | SEQ ID NO: 1072 |
| | | Probe | TAATTAGACCTAGGCCTCAGCTGCACTGCC | SEQ ID NO: 1073 |
| | | RPr | GGTCTGCCCAAATGCTTTTC | SEQ ID NO: 1074 |
| HSPA8 | NM_006597.3 | FPr | CCTCCCTCTGGTGGTGCTT | SEQ ID NO: 1075 |
| | | Probe | CTCAGGGCCCACCATTGAAGAGGTTG | SEQ ID NO: 1076 |
| | | RPr | GCTACATCTACACTTGGTTGGCTTAA | SEQ ID NO: 1077 |
| HSPB1 | NM_001540.2 | FPr | CCGACTGGAGGAGCATAAA | SEQ ID NO: 1078 |
| | | Probe | CGCACTTTTCTGAGCAGACGTCCA | SEQ ID NO: 1079 |
| | | RPr | ATGCTGGCTGACTCTGCTC | SEQ ID NO: 1080 |
| HSPCA | NM_005348.2 | FPr | CAAAAGGCAGAGGCTGATAA | SEQ ID NO: 1081 |
| | | Probe | TGACCAGATCCTTCACAGACTTGTCGT | SEQ ID NO: 1082 |
| | | RPr | AGCGCAGTTTCATAAAGCAA | SEQ ID NO: 1083 |
| HSPE1 | NM_002157.1 | FPr | GCAAGCAACAGTAGTCGCTG | SEQ ID NO: 1084 |
| | | Probe | TCTCCACCCTTTCCTTTAGAACCCG | SEQ ID NO: 1085 |
| | | RPr | CCAACTTTCACGCTAACTGGT | SEQ ID NO: 1086 |
| HSPG2 | NM_005529.2 | FPr | GAGTACGTGTGCCGAGTGTT | SEQ ID NO: 1087 |
| | | Probe | CAGCTCCGTGCCTCTAGAGGCCT | SEQ ID NO: 1088 |
| | | RPr | CTCAATGGTGACCAGGACA | SEQ ID NO: 1089 |
| ICAM1 | NM_000201.1 | FPr | GCAGACAGTGACCATCTACAGCTT | SEQ ID NO: 1090 |
| | | Probe | CCGGCGCCCAACGTGATTCT | SEQ ID NO: 1091 |
| | | RPr | CTTCTGAGACCTCTGGCTTCGT | SEQ ID NO: 1092 |
| ICAM2 | NM_000873.2 | FPr | GGTCATCCTGACACTGCAAC | SEQ ID NO: 1093 |
| | | Probe | TTGCCCACAGCCACCAAAGTG | SEQ ID NO: 1094 |
| | | RPr | TGCACTCAATGGTGAAGGAC | SEQ ID NO: 1095 |
| ID1 | NM_002165.1 | FPr | AGAACCGCAAGGTGAGCAA | SEQ ID NO: 1096 |
| | | Probe | TGGAGATTCTCCAGCACGTCATCGAC | SEQ ID NO: 1097 |
| | | RPr | TCCAACTGAAGGTCCCTGATG | SEQ ID NO: 1098 |
| ID2 | NM_002166.1 | FPr | AACGACTGCTACTCCAAGCTCAA | SEQ ID NO: 1099 |
| | | Probe | TGCCCAGCATCCCCCAGAACAA | SEQ ID NO: 1100 |
| | | RPr | GGATTTCCATCTTGCTCACCTT | SEQ ID NO: 1101 |
| ID3 | NM_002167.2 | FPr | CTTCACCAAATCCCTTCCTG | SEQ ID NO: 1102 |
| | | Probe | TCACAGTCCTTCGCTCCTGAGCAC | SEQ ID NO: 1103 |
| | | RPr | CTCTGGCTCTTCAGGCTACA | SEQ ID NO: 1104 |
| ID4 | NM_001546.2 | FPr | TGGCCTGGCTCTTAATTTG | SEQ ID NO: 1105 |
| | | Probe | CTTTTGTTTTGCCCAGTATAGACTCGGAAG | SEQ ID NO: 1106 |
| | | RPr | TGCAATCATGCAAGACCAC | SEQ ID NO: 1107 |
| IFIT1 | NM_001548.1 | FPr | TGACAACCAAGCAAATGTGA | SEQ ID NO: 1108 |
| | | Probe | AAGTTGCCCCAGGTCACCAGACTC | SEQ ID NO: 1109 |
| | | RPr | CAGTCTGCCCATGTGGTAAT | SEQ ID NO: 1110 |
| IGF1 | NM_000618.1 | FPr | TCCGGAGCTGTGATCTAAGGA | SEQ ID NO: 1111 |
| | | Probe | TGTATTGCGCACCCCTCAAGCCTG | SEQ ID NO: 1112 |
| | | RPr | CGGACAGAGCGAGCTGACTT | SEQ ID NO: 1113 |
| IGF1R | NM_000875.2 | FPr | GCATGGTAGCCGAAGATTTCA | SEQ ID NO: 1114 |
| | | Probe | CGCGTCATACCAAAATCTCCGATTTGA | SEQ ID NO: 1115 |
| | | RPr | TTTCCGGTAATAGTCTGTCTCATAGATATC | SEQ ID NO: 1116 |
| IGF2 | NM_000612.2 | FPr | CCGTGCTTCCGGACAACTT | SEQ ID NO: 1117 |

TABLE A-continued

| Gene | Accession | Reagt | Sequence | SEQ ID NO |
|---|---|---|---|---|
| | | Probe | TACCCCGTGGGCAAGTTCTTCCAA | SEQ ID NO: 1118 |
| | | RPr | TGGACTGCTTCCAGGTGTCA | SEQ ID NO: 1119 |
| IGFBP2 | NM_000597.1 | FPr | GTGGACAGCACCATGAACA | SEQ ID NO: 1120 |
| | | Probe | CTTCCGGCCAGCACTGCCTC | SEQ ID NO: 1121 |
| | | RPr | CCTTCATACCCGACTTGAGG | SEQ ID NO: 1122 |
| IGFBP3 | NM_000598.1 | FPr | ACGCACCGGGTGTCTGA | SEQ ID NO: 1123 |
| | | Probe | CCCAAGTTCCACCCCCTCCATTCA | SEQ ID NO: 1124 |
| | | RPr | TGCCCTTTCTTGATGATGATTATC | SEQ ID NO: 1125 |
| IGFBP5 | NM_000599.1 | FPr | TGGACAAGTACGGGATGAAGCT | SEQ ID NO: 1126 |
| | | Probe | CCCGTCAACGTACTCCATGCCTGG | SEQ ID NO: 1127 |
| | | RPr | CGAAGGTGTGGCACTGAAAGT | SEQ ID NO: 1128 |
| IGFBP6 | NM_002178.1 | FPr | TGAACCGCAGAGACCAACAG | SEQ ID NO: 1129 |
| | | Probe | ATCCAGGCACCTCTACCACGCCCTC | SEQ ID NO: 1130 |
| | | RPr | GTCTTGGACACCCGCAGAAT | SEQ ID NO: 1131 |
| IGFBP7 | NM_001553 | FPr | GGGTCACTATGGAGTTCAAAGGA | SEQ ID NO: 1132 |
| | | Probe | CCCGTCACCAGGCAGGAGTTCT | SEQ ID NO: 1133 |
| | | RPr | GGGTCTGAATGGCCAGGTT | SEQ ID NO: 1134 |
| IHH | NM_002181.1 | FPr | AAGGACGAGGAGAACACAGG | SEQ ID NO: 1135 |
| | | Probe | ATGACCCAGCGCTGCAAGGAC | SEQ ID NO: 1136 |
| | | RPr | AGATAGCCAGCGAGTTCAGG | SEQ ID NO: 1137 |
| IL-8 | NM_000584.2 | FPr | AAGGAACCATCTCACTGTGTGTAAAC | SEQ ID NO: 1138 |
| | | Probe | TGACTTCCAAGCTGGCCGTGGC | SEQ ID NO: 1139 |
| | | RPr | ATCAGGAAGGCTGCCAAGAG | SEQ ID NO: 1140 |
| IL10 | NM_000572.1 | FPr | GGCGCTGTCATCGATTTCTT | SEQ ID NO: 1141 |
| | | Probe | CTGCTCCACGGCCTTGCTCTTG | SEQ ID NO: 1142 |
| | | RPr | TGGAGCTTATTAAAGGCATTCTTCA | SEQ ID NO: 1143 |
| IL1B | NM_000576.2 | FPr | AGCTGAGGAAGATGCTGGTT | SEQ ID NO: 1144 |
| | | Probe | TGCCCACAGACCTTCCAGGAGAAT | SEQ ID NO: 1145 |
| | | RPr | GGAAAGAAGGTGCTCAGGTC | SEQ ID NO: 1146 |
| IL6 | NM_000600.1 | FPr | CCTGAACCTTCCAAAGATGG | SEQ ID NO: 1147 |
| | | Probe | CCAGATTGGAAGCATCCATCTTTTTCA | SEQ ID NO: 1148 |
| | | RPr | ACCAGGCAAGTCTCCTCATT | SEQ ID NO: 1149 |
| IL6ST | NM_002184.2 | FPr | GGCCTAATGTTCCAGATCCT | SEQ ID NO: 1150 |
| | | Probe | CATATTGCCCAGTGGTCACCTCACA | SEQ ID NO: 1151 |
| | | RPr | AAAATTGTGCCTTGGAGGAG | SEQ ID NO: 1152 |
| ILT-2 | NM_006669.1 | FPr | AGCCATCACTCTCAGTGCAG | SEQ ID NO: 1153 |
| | | Probe | CAGGTCCTATCGTGGCCCTGA | SEQ ID NO: 1154 |
| | | RPr | ACTGCAGAGTCAGGGTCTCC | SEQ ID NO: 1155 |
| IMP-1 | NM_006546.2 | FPr | GAAAGTGTTTGCGGAGCAC | SEQ ID NO: 1156 |
| | | Probe | CTCCTACAGCGGCCAGTTCTTGGT | SEQ ID NO: 1157 |
| | | RPr | GAAGGCGTAGCCGGATTT | SEQ ID NO: 1158 |
| IMP2 | NM_006548.3 | FPr | CAATCTGATCCCAGGGTTGAA | SEQ ID NO: 1159 |
| | | Probe | CTCAGCGCACTTGGCATCTTTTCAACA | SEQ ID NO: 1160 |
| | | RPr | GGCCCTGCTGGTGGAGATA | SEQ ID NO: 1161 |
| ING1L | NM_001564.1 | FPr | TGTTTCCAAGATCCTGCTGA | SEQ ID NO: 1162 |
| | | Probe | CCATCTTTGCTTTATCTGAGGCTCGTTC | SEQ ID NO: 1163 |
| | | RPr | TCTTTCTGGTTGGCTGGAAT | SEQ ID NO: 1164 |
| ING5 | NM_032329.4 | FPr | CCTACAGCAAGTGCAAGGAA | SEQ ID NO: 1165 |
| | | Probe | CCAGCTGCACTTTGTCGTCACTGT | SEQ ID NO: 1166 |
| | | RPr | CATCTCGTAGGTCTGCATGG | SEQ ID NO: 1167 |
| INHA | NM_002191.2 | FPr | CCTCCCAGTTTCATCTTCCACTA | SEQ ID NO: 1168 |
| | | Probe | ATGTGCAGCCCACAACCACCATGA | SEQ ID NO: 1169 |
| | | RPr | AGGGACTGGAAGGGACAGGTT | SEQ ID NO: 1170 |
| INHBA | NM_002192.1 | FPr | GTGCCCGAGCCATATAGCA | SEQ ID NO: 1171 |
| | | Probe | ACGTCCGGGTCCTCACTGTCCTTCC | SEQ ID NO: 1172 |
| | | RPr | CGGTAGTGGTTGATGACTGTTGA | SEQ ID NO: 1173 |
| INHBB | NM_002193.1 | FPr | AGCCTCCAGGATACCAGCAA | SEQ ID NO: 1174 |
| | | Probe | AGCTAAGCTGCCATTTGTCACCG | SEQ ID NO: 1175 |
| | | RPr | TCTCCGACTGCAGGCATTTG | SEQ ID NO: 1176 |

TABLE A-continued

| Gene | Accession | Reagt | Sequence | SEQ ID NO |
|---|---|---|---|---|
| IRS1 | NM_005544.1 | FPr | CCACAGCTCACCTTCTGTCA | SEQ ID NO: 1177 |
| | | Probe | TCCATCCCAGCTCCAGCCAG | SEQ ID NO: 1178 |
| | | RPr | CCTCAGTGCCAGTCTCTTCC | SEQ ID NO: 1179 |
| ITGA3 | NM_002204.1 | FPr | CCATGATCCTCACTCTGCTG | SEQ ID NO: 1180 |
| | | Probe | CACTCCAGACCTCGCTTAGCATGG | SEQ ID NO: 1181 |
| | | RPr | GAAGCTTTGTAGCCGGTGAT | SEQ ID NO: 1182 |
| ITGA4 | NM_000885.2 | FPr | CAACGCTTCAGTGATCAATCC | SEQ ID NO: 1183 |
| | | Probe | CGATCCTGCATCTGTAAATCGCCC | SEQ ID NO: 1184 |
| | | RPr | GTCTGGCCGGGATTCTTT | SEQ ID NO: 1185 |
| ITGA5 | NM_002205.1 | FPr | AGGCCAGCCCTACATTATCA | SEQ ID NO: 1186 |
| | | Probe | TCTGAGCCTTGTCCTCTATCCGGC | SEQ ID NO: 1187 |
| | | RPr | GTCTTCTCCACAGTCCAGCA | SEQ ID NO: 1188 |
| ITGA6 | NM_000210.1 | FPr | CAGTGACAAACAGCCCTTCC | SEQ ID NO: 1189 |
| | | Probe | TCGCCATCTTTTGTGGGATTCCTT | SEQ ID NO: 1190 |
| | | RPr | GTTTAGCCTCATGGGCGTC | SEQ ID NO: 1191 |
| ITGA7 | NM_002206.1 | FPr | GATATGATTGGTCGCTGCTTTG | SEQ ID NO: 1192 |
| | | Probe | CAGCCAGGACCTGGCCATCCG | SEQ ID NO: 1193 |
| | | RPr | AGAACTTCCATTCCCCACCAT | SEQ ID NO: 1194 |
| ITGAV | NM_002210.2 | FPr | ACTCGGACTGCACAAGCTATT | SEQ ID NO: 1195 |
| | | Probe | CCGACAGCCACAGAATAACCCAAA | SEQ ID NO: 1196 |
| | | RPr | TGCCATCACCATTGAAATCT | SEQ ID NO: 1197 |
| ITGB1 | NM_002211.2 | FPr | TCAGAATTGGATTTGGCTCA | SEQ ID NO: 1198 |
| | | Probe | TGCTAATGTAAGGCATCACAGTCTTTTCCA | SEQ ID NO: 1199 |
| | | RPr | CCTGAGCTTAGCTGGTGTTG | SEQ ID NO: 1200 |
| ITGB3 | NM_000212.1 | FPr | ACCGGGAGCCCTACATGAC | SEQ ID NO: 1201 |
| | | Probe | AAATACCTGCAACCGTTACTGCCGTGAC | SEQ ID NO: 1202 |
| | | RPr | CCTTAAGCTCTTTCACTGACTCAATCT | SEQ ID NO: 1203 |
| ITGB4 | NM_000213.2 | FPr | CAAGGTGCCCTCAGTGGA | SEQ ID NO: 1204 |
| | | Probe | CACCAACCTGTACCCGTATTGCGA | SEQ ID NO: 1205 |
| | | RPr | GCGCACACCTTCATCTCAT | SEQ ID NO: 1206 |
| ITGB5 | NM_002213.3 | FPr | TCGTGAAAGATGACCAGGAG | SEQ ID NO: 1207 |
| | | Probe | TGCTATGTTTCTACAAAACCGCCAAGG | SEQ ID NO: 1208 |
| | | RPr | GGTGAACATCATGACGCAGT | SEQ ID NO: 1209 |
| K-ras | NM_033360.2 | FPr | GTCAAAATGGGGAGGGACTA | SEQ ID NO: 1210 |
| | | Probe | TGTATCTTGTTGAGCTATCCAAACTGCCC | SEQ ID NO: 1211 |
| | | RPr | CAGGACCACCACAGAGTGAG | SEQ ID NO: 1212 |
| KCNH2 iso a/b | NM_000238.2 | FPr | GAGCGCAAAGTGGAAATCG | SEQ ID NO: 1213 |
| | | Probe | TAGGAAGCAGCTCCCATCTTTCCGGTA | SEQ ID NO: 1214 |
| | | RPr | TCTTCACGGGCACCACATC | SEQ ID NO: 1215 |
| KCNH2 iso a/c | NM_172057.1 | FPr | TCCTGCTGCTGGTCATCTAC | SEQ ID NO: 1216 |
| | | Probe | TGTCTTCACACCCTACTCGGCTGC | SEQ ID NO: 1217 |
| | | RPr | CCTTCTTCCGTCTCCTTCAG | SEQ ID NO: 1218 |
| KCNK4 | NM_016611.2 | FPr | CCTATCAGCCGCTGGTGT | SEQ ID NO: 1219 |
| | | Probe | ATCCTGCTCGGCCTGGCTTACTTC | SEQ ID NO: 1220 |
| | | RPr | TGGTGGTGAGCACTGAGG | SEQ ID NO: 1221 |
| KDR | NM_002253.1 | FPr | GAGGACGAAGGCCTCTACAC | SEQ ID NO: 1222 |
| | | Probe | CAGGCATGCAGTGTTCTTGGCTGT | SEQ ID NO: 1223 |
| | | RPr | AAAAATGCCTCCACTTTTGC | SEQ ID NO: 1224 |
| Ki-67 | NM_002417.1 | FPr | CGGACTTTGGGTGCGACTT | SEQ ID NO: 1225 |
| | | Probe | CCACTTGTCGAACCACCGCTCGT | SEQ ID NO: 1226 |
| | | RPr | TTACAACTCTTCCACTGGGACGAT | SEQ ID NO: 1227 |
| KIAA0125 | NM_014792.2 | FPr | GTGTCCTGGTCCATGTGGT | SEQ ID NO: 1228 |
| | | Probe | CACGTGTCTCCACCTCCAAGGAGA | SEQ ID NO: 1229 |
| | | RPr | GGGAGGTGCACACTGAGG | SEQ ID NO: 1230 |
| KIF22 | NM_007317.1 | FPr | CTAAGGCACTTGCTGGAAGG | SEQ ID NO: 1231 |
| | | Probe | TCCATAGGCAAGCACACTGGCATT | SEQ ID NO: 1232 |
| | | RPr | TCTTCCCAGCTCCTGTGG | SEQ ID NO: 1233 |
| KIF2C | NM_006845.2 | FPr | AATTCCTGCTCCAAAAGAAAGTCTT | SEQ ID NO: 1234 |

TABLE A-continued

| Gene | Accession | Reagt | Sequence | SEQ ID NO |
|------|-----------|-------|----------|-----------|
|  |  | Probe | AAGCCGCTCCACTCGCATGTCC | SEQ ID NO: 1235 |
|  |  | RPr | CGTGATGCGAAGCTCTGAGA | SEQ ID NO: 1236 |
| KIFC1 | XM_371813.1 | FPr | CCACAGGGTTGAAGAACCAG | SEQ ID NO: 1237 |
|  |  | Probe | AGCCAGTTCCTGCTGTTCCTGTCC | SEQ ID NO: 1238 |
|  |  | RPr | CACCTGATGTGCCAGACTTC | SEQ ID NO: 1239 |
| Kitlng | NM_000899.1 | FPr | GTCCCCGGGATGGATGTT | SEQ ID NO: 1240 |
|  |  | Probe | CATCTCGCTTATCCAACAATGACTTGGCA | SEQ ID NO: 1241 |
|  |  | RPr | GATCAGTCAAGCTGTCTGACAATTG | SEQ ID NO: 1242 |
| KLF5 | NM_001730.3 | FPr | GTGCAACCGCAGCTTCTC | SEQ ID NO: 1243 |
|  |  | Probe | CTCTGACCACCTGGCCCTGCATAT | SEQ ID NO: 1244 |
|  |  | RPr | CGGGCAGTGCTCAGTTCT | SEQ ID NO: 1245 |
| KLF6 | NM_001300.4 | FPr | CACGAGACCGGCTACTTCTC | SEQ ID NO: 1246 |
|  |  | Probe | AGTACTCCTCCAGAGACGGCAGCG | SEQ ID NO: 1247 |
|  |  | RPr | GCTCTAGGCAGGTCTGTTGC | SEQ ID NO: 1248 |
| KLK10 | NM_002776.1 | FPr | GCCCAGAGGCTCCATCGT | SEQ ID NO: 1249 |
|  |  | Probe | CCTCTTCCTCCCCAGTCGGCTGA | SEQ ID NO: 1250 |
|  |  | RPr | CAGAGGTTTGAACAGTGCAGACA | SEQ ID NO: 1251 |
| KLK6 | NM_002774.2 | FPr | GACGTGAGGGTCCTGATTCT | SEQ ID NO: 1252 |
|  |  | Probe | TTACCCCAGCTCCATCCTTGCATC | SEQ ID NO: 1253 |
|  |  | RPr | TCCTCACTCATCACGTCCTC | SEQ ID NO: 1254 |
| KLRK1 | NM_007360.1 | FPr | TGAGAGCCAGGCTTCTTGTA | SEQ ID NO: 1255 |
|  |  | Probe | TGTCTCAAAATGCCAGCCTTCTGAA | SEQ ID NO: 1256 |
|  |  | RPr | ATCCTGGTCCTCTTTGCTGT | SEQ ID NO: 1257 |
| KNTC2 | NM_006101.1 | FPr | ATGTGCCAGTGAGCTTGAGT | SEQ ID NO: 1258 |
|  |  | Probe | CCTTGGAGAAACACAAGCACCTGC | SEQ ID NO: 1259 |
|  |  | RPr | TGAGCCCCTGGTTAACAGTA | SEQ ID NO: 1260 |
| KRAS2 | NM_004985.3 | FPr | GAGACCAAGGTTGCAAGGC | SEQ ID NO: 1261 |
|  |  | Probe | AAGCTCAAAGGTTCACACAGGGCC | SEQ ID NO: 1262 |
|  |  | RPr | CAGTCCATGCTGTGAAACTCTC | SEQ ID NO: 1263 |
| KRT19 | NM_002276.1 | FPr | TGAGCGGCAGAATCAGGAGTA | SEQ ID NO: 1264 |
|  |  | Probe | CTCATGGACATCAAGTCGCGGCTG | SEQ ID NO: 1265 |
|  |  | RPr | TGCGGTAGGTGGCAATCTC | SEQ ID NO: 1266 |
| KRT8 | NM_002273.1 | FPr | GGATGAAGCTTACATGAACAAGGTAGA | SEQ ID NO: 1267 |
|  |  | Probe | CGTCGGTCAGCCCTTCCAGGC | SEQ ID NO: 1268 |
|  |  | RPr | CATATAGCTGCCTGAGGAAGTTGAT | SEQ ID NO: 1269 |
| LAMA3 | NM_000227.2 | FPr | CAGATGAGGCACATGGAGAC | SEQ ID NO: 1270 |
|  |  | Probe | CTGATTCCTCAGGTCCTTGGCCTG | SEQ ID NO: 1271 |
|  |  | RPr | TTGAAATGGCAGAACGGTAG | SEQ ID NO: 1272 |
| LAMB3 | NM_000228.1 | FPr | ACTGACCAAGCCTGAGACCT | SEQ ID NO: 1273 |
|  |  | Probe | CCACTCGCCATACTGGGTGCAGT | SEQ ID NO: 1274 |
|  |  | RPr | GTCACACTTGCAGCATTTCA | SEQ ID NO: 1275 |
| LAMC2 | NM_005562.1 | FPr | ACTCAAGCGGAAATTGAAGCA | SEQ ID NO: 1276 |
|  |  | Probe | AGGTCTTATCAGCACAGTCTCCGCCTCC | SEQ ID NO: 1277 |
|  |  | RPr | ACTCCCTGAAGCCGAGACACT | SEQ ID NO: 1278 |
| LAT | NM_014387.2 | FPr | GTGAACGTTCCGGAGAGC | SEQ ID NO: 1279 |
|  |  | Probe | ATCCAGAGACGCTTCTGCGCTCTC | SEQ ID NO: 1280 |
|  |  | RPr | ACATTCACATACTCCCGGCT | SEQ ID NO: 1281 |
| LCN2 | NM_005564.2 | FPr | CGCTGGGCAACATTAAGAG | SEQ ID NO: 1282 |
|  |  | Probe | TCACCACTCGGACGAGGTAACTCG | SEQ ID NO: 1283 |
|  |  | RPr | AGCATGCTGGTTGTAGTTGGT | SEQ ID NO: 1284 |
| LDLRAP1 | NM_015627.1 | FPr | CAGTGCCTCTCGCCTGTC | SEQ ID NO: 1285 |
|  |  | Probe | ACTGGGACAAGCCTGACAGCAGC | SEQ ID NO: 1286 |
|  |  | RPr | TGAAGAGGTCATCCTGCTCTG | SEQ ID NO: 1287 |
| LEF | NM_016269.2 | FPr | GATGACGGAAAGCATCCAG | SEQ ID NO: 1288 |
|  |  | Probe | TGGAGGCCTCTACAACAAGGGACC | SEQ ID NO: 1289 |
|  |  | RPr | CCCGGAATAACTCGAGTAGGA | SEQ ID NO: 1290 |
| LGALS3 | NM_002306.1 | FPr | AGCGGAAAATGGCAGACAAT | SEQ ID NO: 1291 |
|  |  | Probe | ACCCAGATAACGCATCATGGAGCGA | SEQ ID NO: 1292 |
|  |  | RPr | CTTGAGGGTTTGGGTTTCCA | SEQ ID NO: 1293 |

TABLE A-continued

| Gene | Accession | Reagt | Sequence | SEQ ID NO |
|---|---|---|---|---|
| LGMN | NM_001008530.1 | FPr | TTGGTGCCGTTCCTATAGATG | SEQ ID NO: 1294 |
| | | Probe | CAGTGCTTGCCTCCATCTTCAGGA | SEQ ID NO: 1295 |
| | | RPr | GAACCTGCCACGATCACC | SEQ ID NO: 1296 |
| LILRB3 | NM_006864.1 | FPr | CACCTGGTCTGGGAAGATACC | SEQ ID NO: 1297 |
| | | Probe | ACCGAGACCCCAATCAAAACCTCC | SEQ ID NO: 1298 |
| | | RPr | AAGAGCAGCAGGACGAAGG | SEQ ID NO: 1299 |
| LMNB1 | NM_005573.1 | FPr | TGCAAACGCTGGTGTCACA | SEQ ID NO: 1300 |
| | | Probe | CAGCCCCCAACTGACCTCATC | SEQ ID NO: 1301 |
| | | RPr | CCCCACGAGTTCTGGTTCTTC | SEQ ID NO: 1302 |
| LMYC | NM_012421.1 | FPr | CCCATCCAGAACACTGATTG | SEQ ID NO: 1303 |
| | | Probe | TGACCTCCATCCCTTTCACTTGAATG | SEQ ID NO: 1304 |
| | | RPr | CTGCTTTCTATGCACCCTTTC | SEQ ID NO: 1305 |
| LOX | NM_002317.3 | FPr | CCAATGGGAGAACAACGG | SEQ ID NO: 1306 |
| | | Probe | CAGGCTCAGCAAGCTGAACACCTG | SEQ ID NO: 1307 |
| | | RPr | CGCTGAGGCTGGTACTGTG | SEQ ID NO: 1308 |
| LOXL2 | NM_002318.1 | FPr | TCAGCGGGCTCTTAAACAA | SEQ ID NO: 1309 |
| | | Probe | CAGCTGTCCCCGCAGTAAAGAAGC | SEQ ID NO: 1310 |
| | | RPr | AAGACAGGAGTTGACCACGC | SEQ ID NO: 1311 |
| LRP5 | NM_002335.1 | FPr | CGACTATGACCCACTGGACA | SEQ ID NO: 1312 |
| | | Probe | CGCCCATCCACCCAGTAGATGAAC | SEQ ID NO: 1313 |
| | | RPr | CTTGGCTCGCTTGATGTTC | SEQ ID NO: 1314 |
| LRP6 | NM_002336.1 | FPr | GGATGTAGCCATCTCTGCCT | SEQ ID NO: 1315 |
| | | Probe | ATAGACCTCAGGGCCTTCGCTGTG | SEQ ID NO: 1316 |
| | | RPr | AGTTCAAAGCCAATAGGGCA | SEQ ID NO: 1317 |
| LY6D | NM_003695.2 | FPr | AATGCTGATGACTTGGAGCAG | SEQ ID NO: 1318 |
| | | Probe | CACAGACCCCACAGAGGATGAAGC | SEQ ID NO: 1319 |
| | | RPr | CTGCATCCTCTGTGGGGT | SEQ ID NO: 1320 |
| MAD | NM_002357.1 | FPr | TGGTTCTGATTAGGTAACGTATTGGA | SEQ ID NO: 1321 |
| | | Probe | CTGCCCACAACTCCCTTGCACGTAA | SEQ ID NO: 1322 |
| | | RPr | GGTCAAGGTGGGACACTGAAG | SEQ ID NO: 1323 |
| MAD1L1 | NM_003550.1 | FPr | AGAAGCTGTCCCTGCAAGAG | SEQ ID NO: 1324 |
| | | Probe | CATGTTCTTCACAATGCTGCATCC | SEQ ID NO: 1325 |
| | | RPr | AGCCGTACCAGCTCAGACTT | SEQ ID NO: 1326 |
| MAD2L1 | NM_002358.2 | FPr | CCGGGAGCAGGGAATCAC | SEQ ID NO: 1327 |
| | | Probe | CGGCCACGATTTCGGCGCT | SEQ ID NO: 1328 |
| | | RPr | ATGCTGTTGATGCCGAATGA | SEQ ID NO: 1329 |
| MADH2 | NM_005901.2 | FPr | GCTGCCTTTGGTAAGAACATGTC | SEQ ID NO: 1330 |
| | | Probe | TCCATCTTGCCATTCACGCCGC | SEQ ID NO: 1331 |
| | | RPr | ATCCCAGCAGTCTCTTCACAACT | SEQ ID NO: 1332 |
| MADH4 | NM_005359.3 | FPr | GGACATTACTGGCCTGTTCACA | SEQ ID NO: 1333 |
| | | Probe | TGCATTCCAGCCTCCCATTTCCA | SEQ ID NO: 1334 |
| | | RPr | ACCAATACTCAGGAGCAGGATGA | SEQ ID NO: 1335 |
| MADH7 | NM_005904.1 | FPr | TCCATCAAGGCTTTCGACTA | SEQ ID NO: 1336 |
| | | Probe | CTGCAGGCTGTACGCCTTCTCG | SEQ ID NO: 1337 |
| | | RPr | CTGCTGCATAAACTCGTGGT | SEQ ID NO: 1338 |
| MAP2 | NM_031846.1 | FPr | CGGACCACCAGGTCAGAG | SEQ ID NO: 1339 |
| | | Probe | CCACTCTTCCCTGCTCTGCGAATT | SEQ ID NO: 1340 |
| | | RPr | CAGGGGTAGTGGGTGTTGAG | SEQ ID NO: 1341 |
| MAP2K1 | NM_002755.2 | FPr | GCCTTTCTTACCCAGAAGCAGAA | SEQ ID NO: 1342 |
| | | Probe | TCTCAAAGTCGTCATCCTTCAGTTCTCCCA | SEQ ID NO: 1343 |
| | | RPr | CAGCCCCCAGCTCACTGAT | SEQ ID NO: 1344 |
| MAP3K1 | XM_042066.8 | FPr | GGTTGGCATCAAAAGGAACT | SEQ ID NO: 1345 |
| | | Probe | AATTGTCCCTGAAACTCTCCTGCACC | SEQ ID NO: 1346 |
| | | RPr | TGCCATAAATGCAATTGTCC | SEQ ID NO: 1347 |
| MAPK14 | NM_139012.1 | FPr | TGAGTGGAAAAGCCTGACCTATG | SEQ ID NO: 1348 |
| | | Probe | TGAAGTCATCAGCTTTGTGCCACCACC | SEQ ID NO: 1349 |
| | | RPr | GGACTCCATCTCTTCTTGGTCAA | SEQ ID NO: 1350 |
| Maspin | NM_002639.1 | FPr | CAGATGGCCACTTTGAGAACATT | SEQ ID NO: 1351 |

TABLE A-continued

| Gene | Accession | Reagt | Sequence | SEQ ID NO |
|---|---|---|---|---|
| | | Probe | AGCTGACAACAGTGTGAACGACCAGACC | SEQ ID NO: 1352 |
| | | RPr | GGCAGCATTAACCACAAGGATT | SEQ ID NO: 1353 |
| MAX | NM_002382.3 | FPr | CAAACGGGCTCATCATAATGC | SEQ ID NO: 1354 |
| | | Probe | TGATGTGGTCCCTACGTTTTCGTTCCA | SEQ ID NO: 1355 |
| | | RPr | TCCCGCAAACTGTGAAAGCT | SEQ ID NO: 1356 |
| MCM2 | NM_004526.1 | FPr | GACTTTTGCCCGCTACCTTTC | SEQ ID NO: 1357 |
| | | Probe | ACAGCTCATTGTTGTCACGCCGGA | SEQ ID NO: 1358 |
| | | RPr | GCCACTAACTGCTTCAGTATGAAGAG | SEQ ID NO: 1359 |
| MCM3 | NM_002388.2 | FPr | GGAGAACAATCCCCTTGAGA | SEQ ID NO: 1360 |
| | | Probe | TGGCCTTTCTGTCTACAAGGATCACCA | SEQ ID NO: 1361 |
| | | RPr | ATCTCCTGGATGGTGATGGT | SEQ ID NO: 1362 |
| MCM6 | NM_005915.2 | FPr | TGATGGTCCTATGTGTCACATTCA | SEQ ID NO: 1363 |
| | | Probe | CAGGTTTCATACCAACACAGGCTTCAGCAC | SEQ ID NO: 1364 |
| | | RPr | TGGGACAGGAAACACACCAA | SEQ ID NO: 1365 |
| MCP1 | NM_002982.1 | FPr | CGCTCAGCCAGATGCAATC | SEQ ID NO: 1366 |
| | | Probe | TGCCCCAGTCACCTGCTGTTA | SEQ ID NO: 1367 |
| | | RPr | GCACTGAGATCTTCCTATTGGTGAA | SEQ ID NO: 1368 |
| MDK | NM_002391.2 | FPr | GGAGCCGACTGCAAGTACA | SEQ ID NO: 1369 |
| | | Probe | ATCACACGCACCCCAGTTCTCAAA | SEQ ID NO: 1370 |
| | | RPr | GACTTTGGTGCCTGTGCC | SEQ ID NO: 1371 |
| MDM2 | NM_002392.1 | FPr | CTACAGGGACGCCATCGAA | SEQ ID NO: 1372 |
| | | Probe | CTTACACCAGCATCAAGATCCGG | SEQ ID NO: 1373 |
| | | RPr | ATCCAACCAATCACCTGAATGTT | SEQ ID NO: 1374 |
| MGAT5 | NM_002410.2 | FPr | GGAGTCGAAGGTGGACAATC | SEQ ID NO: 1375 |
| | | Probe | AATGGCACCGGAACAAACTCAACC | SEQ ID NO: 1376 |
| | | RPr | TGGGAACAGCTGTAGTGGAGT | SEQ ID NO: 1377 |
| MGMT | NM_002412.1 | FPr | GTGAAATGAAACGCACCACA | SEQ ID NO: 1378 |
| | | Probe | CAGCCCTTTGGGGAAGCTGG | SEQ ID NO: 1379 |
| | | RPr | GACCCTGCTCACAACCAGAC | SEQ ID NO: 1380 |
| mGST1 | NM_020300.2 | FPr | ACGGATCTACCACACCATTGC | SEQ ID NO: 1381 |
| | | Probe | TTTGACACCCCTTCCCCAGCCA | SEQ ID NO: 1382 |
| | | RPr | TCCATATCCAACAAAAAAACTCAAAG | SEQ ID NO: 1383 |
| MMP1 | NM_002421.2 | FPr | GGGAGATCATCGGGACAACTC | SEQ ID NO: 1384 |
| | | Probe | AGCAAGATTTCCTCCAGGTCCATCAAAAGG | SEQ ID NO: 1385 |
| | | RPr | GGGCCTGGTTGAAAAGCAT | SEQ ID NO: 1386 |
| MMP12 | NM_002426.1 | FPr | CCAACGCTTGCCAAATCCT | SEQ ID NO: 1387 |
| | | Probe | AACCAGCTCTCTGTGACCCCAATT | SEQ ID NO: 1388 |
| | | RPr | ACGGTAGTGACAGCATCAAAACTC | SEQ ID NO: 1389 |
| MMP2 | NM_004530.1 | FPr | CCATGATGGAGAGGCAGACA | SEQ ID NO: 1390 |
| | | Probe | CTGGGAGCATGGCGATGGATACCC | SEQ ID NO: 1391 |
| | | RPr | GGAGTCCGTCCTTACCGTCAA | SEQ ID NO: 1392 |
| MMP7 | NM_002423.2 | FPr | GGATGGTAGCAGTCTAGGGATTAACT | SEQ ID NO: 1393 |
| | | Probe | CCTGTATGCTGCAACTCATGAACTTGGC | SEQ ID NO: 1394 |
| | | RPr | GGAATGTCCCATACCCAAAGAA | SEQ ID NO: 1395 |
| MMP9 | NM_004994.1 | FPr | GAGAACCAATCTCACCGACA | SEQ ID NO: 1396 |
| | | Probe | ACAGGTATTCCTCTGCCAGCTGCC | SEQ ID NO: 1397 |
| | | RPr | CACCCGAGTGTAACCATAGC | SEQ ID NO: 1398 |
| MRP1 | NM_004996.2 | FPr | TCATGGTGCCCGTCAATG | SEQ ID NO: 1399 |
| | | Probe | ACCTGATACGTCTTGGTCTTCATCGCCAT | SEQ ID NO: 1400 |
| | | RPr | CGATTGTCTTTGCTCTTCATGTG | SEQ ID NO: 1401 |
| MRP2 | NM_000392.1 | FPr | AGGGGATGACTTGGACACAT | SEQ ID NO: 1402 |
| | | Probe | CTGCCATTCGACATGACTGCAATTT | SEQ ID NO: 1403 |
| | | RPr | AAAACTGCATGGCTTTGTCA | SEQ ID NO: 1404 |
| MRP3 | NM_003786.2 | FPr | TCATCCTGGCGATCTACTTCCT | SEQ ID NO: 1405 |
| | | Probe | TCTGTCCTGGCTGAGTCGCTTTCAT | SEQ ID NO: 1406 |
| | | RPr | CCGTTGAGTGGAATCAGCAA | SEQ ID NO: 1407 |
| MRP4 | NM_005845.1 | FPr | AGCGCCTGGAATCTACAACT | SEQ ID NO: 1408 |

TABLE A-continued

| Gene | Accession | Reagt | Sequence | SEQ ID NO |
|---|---|---|---|---|
| | | Probe | CGGAGTCCAGTGTTTTCCCACTTG | SEQ ID NO: 1409 |
| | | RPr | AGAGCCCTGGAGAGAAGAT | SEQ ID NO: 1410 |
| MRPL40 | NM_003776.2 | FPr | ACTTGCAGGCTGCTATCCTT | SEQ ID NO: 1411 |
| | | Probe | TTCCTACTCTCAGGGGCAGCATGTT | SEQ ID NO: 1412 |
| | | RPr | AGCAGACTTGAACCCTGGTC | SEQ ID NO: 1413 |
| MSH2 | NM_000251.1 | FPr | GATGCAGAATTGAGGCAGAC | SEQ ID NO: 1414 |
| | | Probe | CAAGAAGATTTACTTCGTCGATTCCCAGA | SEQ ID NO: 1415 |
| | | RPr | TCTTGGCAAGTCGGTTAAGA | SEQ ID NO: 1416 |
| MSH3 | NM_002439.1 | FPr | TGATTACCATCATGGCTCAGA | SEQ ID NO: 1417 |
| | | Probe | TCCCAATTGTCGCTTCTTCTGCAG | SEQ ID NO: 1418 |
| | | RPr | CTTGTGAAAATGCCATCCAC | SEQ ID NO: 1419 |
| MSH6 | NM_000179.1 | FPr | TCTATTGGGGATTGGTAGG | SEQ ID NO: 1420 |
| | | Probe | CCGTTACCAGCTGGAAATTCCTGAGA | SEQ ID NO: 1421 |
| | | RPr | CAAATTGCGAGTGGTGAAAT | SEQ ID NO: 1422 |
| MT3 | NM_005954.1 | FPr | GTGTGAGAAGTGTGCCAAGG | SEQ ID NO: 1423 |
| | | Probe | CTCTCCGCCTTTGCACACAGT | SEQ ID NO: 1424 |
| | | RPr | CTGCACTTCTCTGCTTCTGC | SEQ ID NO: 1425 |
| MTA1 | NM_004689.2 | FPr | CCGCCCTCACCTGAAGAGA | SEQ ID NO: 1426 |
| | | Probe | CCCAGTGTCCGCCAAGGAGCG | SEQ ID NO: 1427 |
| | | RPr | GGAATAAGTTAGCCGCGCTTCT | SEQ ID NO: 1428 |
| MUC1 | NM_002456.1 | FPr | GGCCAGGATCTGTGGTGGTA | SEQ ID NO: 1429 |
| | | Probe | CTCTGGCCTTCCGAGAAGGTACC | SEQ ID NO: 1430 |
| | | RPr | CTCCACGTCGTGGACATTGA | SEQ ID NO: 1431 |
| MUC2 | NM_002457.1 | FPr | CTATGAGCCATGTGGGAACC | SEQ ID NO: 1432 |
| | | Probe | AGCTTCGAGACCTGCAGGACCATC | SEQ ID NO: 1433 |
| | | RPr | ATGTTGGAGTGGATGCCG | SEQ ID NO: 1434 |
| MUC5B | XM_039877.11 | FPr | TGCCCTTGCACTGTCCTAA | SEQ ID NO: 1435 |
| | | Probe | TCAGCCATCCTGCACACCTACACC | SEQ ID NO: 1436 |
| | | RPr | CAGCCACACTCATCCACG | SEQ ID NO: 1437 |
| MUTYH | NM_012222.1 | FPr | GTACGACCAAGAGAAACGGG | SEQ ID NO: 1438 |
| | | Probe | TCTGCCCGTCTTCTCCATGGTAGG | SEQ ID NO: 1439 |
| | | RPr | CCTGTCCAGGTCCATCTCA | SEQ ID NO: 1440 |
| MVP | NM_017458.1 | FPr | ACGAGAACGAGGGCATCTATGT | SEQ ID NO: 1441 |
| | | Probe | CGCACCTTTCCGGTCTTGACATCCT | SEQ ID NO: 1442 |
| | | RPr | GCATGTAGGTGCTTCCAATCAC | SEQ ID NO: 1443 |
| MX1 | NM_002462.2 | FPr | GAAGGAATGGGAATCAGTCATGA | SEQ ID NO: 1444 |
| | | Probe | TCACCCTGGAGATCAGCTCCGA | SEQ ID NO: 1445 |
| | | RPr | GTCTATTAGAGTCAGATCCGGGACAT | SEQ ID NO: 1446 |
| MXD4 | NM_006454.2 | FPr | AGAAACTGGAGGAGCAGGAC | SEQ ID NO: 1447 |
| | | Probe | TGCAGCTGCTCCTTGATGCTCAGT | SEQ ID NO: 1448 |
| | | RPr | CTTCAGGAAACGATGCTCCT | SEQ ID NO: 1449 |
| MYBL2 | NM_002466.1 | FPr | GCCGAGATCGCCAAGATG | SEQ ID NO: 1450 |
| | | Probe | CAGCATTGTCTGTCCTCCCTGGCA | SEQ ID NO: 1451 |
| | | RPr | CTTTTGATGGTAGAGTTCCAGTGATTC | SEQ ID NO: 1452 |
| MYH11 | NM_002474.1 | FPr | CGGTACTTCTCAGGGCTAATATATACG | SEQ ID NO: 1453 |
| | | Probe | CTCTTCTGCGTGGTGGTCAACCCCTA | SEQ ID NO: 1454 |
| | | RPr | CCGAGTAGATGGGCAGGTGTT | SEQ ID NO: 1455 |
| MYLK | NM_053025.1 | FPr | TGACGGAGCGTGAGTGCAT | SEQ ID NO: 1456 |
| | | Probe | CCCTCCGAGATCTGCCGCATGTACT | SEQ ID NO: 1457 |
| | | RPr | ATGCCCTGCTTGTGGATGTAC | SEQ ID NO: 1458 |
| NAT2 | NM_000015.1 | FPr | TAACTGACATTCTTGAGCACCAGAT | SEQ ID NO: 1459 |
| | | Probe | CGGGCTGTTCCCTTTGAGAACCTTAACA | SEQ ID NO: 1460 |
| | | RPr | ATGGCTTGCCCACAATGC | SEQ ID NO: 1461 |
| NAV2 | NM_182964.3 | FPr | CTCTCCCAGCACAGCTTGA | SEQ ID NO: 1462 |
| | | Probe | CCTCACTGAGTCAACCAGCCTGGA | SEQ ID NO: 1463 |
| | | RPr | CACCAGTGTCATCCAGCAAC | SEQ ID NO: 1464 |
| NCAM1 | NM_000615.1 | FPr | TAGTTCCCAGCTGACCATCA | SEQ ID NO: 1465 |
| | | Probe | CTCAGCCTCGTCGTTCTTATCCACC | SEQ ID NO: 1466 |
| | | RPr | CAGCCTTGTTCTCAGCAATG | SEQ ID NO: 1467 |

TABLE A-continued

| Gene | Accession | Reagt | Sequence | SEQ ID NO |
|---|---|---|---|---|
| NDE1 | NM_017668.1 | FPr | CTACTGCGGAAAGTCGGG | SEQ ID NO: 1468 |
| | | Probe | CTGGAGTCCAAACTCGCTTCCTGC | SEQ ID NO: 1469 |
| | | RPr | GGACTGATCGTACACGAGGTT | SEQ ID NO: 1470 |
| NDRG1 | NM_006096.2 | FPr | AGGGCAACATTCCACAGC | SEQ ID NO: 1471 |
| | | Probe | CTGCAAGGACACTCATCACAGCCA | SEQ ID NO: 1472 |
| | | RPr | CAGTGCTCCTACTCCGGC | SEQ ID NO: 1473 |
| NDUFS3 | NM_004551.1 | FPr | TATCCATCCTGATGGCGTC | SEQ ID NO: 1474 |
| | | Probe | CCCAGTGCTGACTTTCCTCAGGGA | SEQ ID NO: 1475 |
| | | RPr | TTGAACTGTGCATTGGTGTG | SEQ ID NO: 1476 |
| NEDD8 | NM_006156.1 | FPr | TGCTGGCTACTGGGTGTTAGT | SEQ ID NO: 1477 |
| | | Probe | TGCAGTCCTGTGTGCTTCCCTCTC | SEQ ID NO: 1478 |
| | | RPr | GACAACCAGGGACACAGTCA | SEQ ID NO: 1479 |
| NEK2 | NM_002497.1 | FPr | GTGAGGCAGCGCGACTCT | SEQ ID NO: 1480 |
| | | Probe | TGCCTTCCCGGGCTGAGGACT | SEQ ID NO: 1481 |
| | | RPr | TGCCAATGGTGTACAACACTTCA | SEQ ID NO: 1482 |
| NF2 | NM_000268.2 | FPr | ACTCCAGAGCTGACCTCCAC | SEQ ID NO: 1483 |
| | | Probe | CTACAATGACTTCCCAGGCTGGGC | SEQ ID NO: 1484 |
| | | RPr | TCAGGGCTTCAGTGTCTCAC | SEQ ID NO: 1485 |
| NFKBp50 | NM_003998.1 | FPr | CAGACCAAGGAGATGGACCT | SEQ ID NO: 1486 |
| | | Probe | AAGCTGTAAACATGAGCCGCACCA | SEQ ID NO: 1487 |
| | | RPr | AGCTGCCAGTGCTATCCG | SEQ ID NO: 1488 |
| NFKBp65 | NM_021975.1 | FPr | CTGCCGGGATGGCTTCTAT | SEQ ID NO: 1489 |
| | | Probe | CTGAGCTCTGCCCGGACCGCT | SEQ ID NO: 1490 |
| | | RPr | CCAGGTTCTGGAAACTGTGGAT | SEQ ID NO: 1491 |
| NISCH | NM_007184.1 | FPr | CCAAGGAATCATGTTCGTTCAG | SEQ ID NO: 1492 |
| | | Probe | TGGCCAGCAGCCTCTCGTCCAC | SEQ ID NO: 1493 |
| | | RPr | TGGTGCTCGGGAGTCAGACT | SEQ ID NO: 1494 |
| Nkd-1 | NM_033119.3 | FPr | GAGAGAGTGAGCGAACCCTG | SEQ ID NO: 1495 |
| | | Probe | CCAGGCTCCAAGAAGCAGCTGAAG | SEQ ID NO: 1496 |
| | | RPr | CGTCGCACTGGAGCTCTT | SEQ ID NO: 1497 |
| NMB | NM_021077.1 | FPr | GGCTGCTGGTACAAATACTGC | SEQ ID NO: 1498 |
| | | Probe | TGTCTGCCCCTATTATTGGTGTCATTTCT | SEQ ID NO: 1499 |
| | | RPr | CAATCTAAGCCACGCTGTTG | SEQ ID NO: 1500 |
| NMBR | NM_002511.1 | FPr | TGATCCATCTCTAGGCCACA | SEQ ID NO: 1501 |
| | | Probe | TTGTCACCTTAGTTGCCCGGGTTC | SEQ ID NO: 1502 |
| | | RPr | GAGCAAATGGGTTGACACAA | SEQ ID NO: 1503 |
| NME1 | NM_000269.1 | FPr | CCAACCCTGCAGACTCCAA | SEQ ID NO: 1504 |
| | | Probe | CCTGGGACCATCCGTGGAGACTTCT | SEQ ID NO: 1505 |
| | | RPr | ATGTATAATGTTCCTGCCAACTTGTATG | SEQ ID NO: 1506 |
| NOS3 | NM_000603.2 | FPr | ATCTCCGCCTCGCTCATG | SEQ ID NO: 1507 |
| | | Probe | TTCACTCGCTTCGCCATCACCG | SEQ ID NO: 1508 |
| | | RPr | TCGGAGCCATACAGGATTGTC | SEQ ID NO: 1509 |
| NOTCH1 | NM_017617.2 | FPr | CGGGTCCACCAGTTTGAATG | SEQ ID NO: 1510 |
| | | Probe | CCGCTCTGCAGCCGGGACA | SEQ ID NO: 1511 |
| | | RPr | GTTGTATTGGTTCGGCACCAT | SEQ ID NO: 1512 |
| NOTCH2 | NM_024408.2 | FPr | CACTTCCCTGCTGGGATTAT | SEQ ID NO: 1513 |
| | | Probe | CCGTGTTGCACAGCTCATCACACT | SEQ ID NO: 1514 |
| | | RPr | AGTTGTCAAACAGGCACTCG | SEQ ID NO: 1515 |
| NPM1 | NM_002520.2 | FPr | AATGTTGTCCAGGTTCTATTGC | SEQ ID NO: 1516 |
| | | Probe | AACAGGCATTTTGGACAACACATTCTTG | SEQ ID NO: 1517 |
| | | RPr | CAAGCAAAGGGTGGAGTTC | SEQ ID NO: 1518 |
| NR4A1 | NM_002135.2 | FPr | CACAGCTTGCTTGTCGATGTC | SEQ ID NO: 1519 |
| | | Probe | CCTTCGCCTGCCTCTCTGCCC | SEQ ID NO: 1520 |
| | | RPr | ATGCCGGTCGGTGATGAG | SEQ ID NO: 1521 |
| NRG1 | NM_013957.1 | FPr | CGAGACTCTCCTCATAGTGAAAGGTAT | SEQ ID NO: 1522 |
| | | Probe | ATGACCACCCCGGCTCGTATGTCA | SEQ ID NO: 1523 |
| | | RPr | CTTGGCGTGTGGAAATCTACAG | SEQ ID NO: 1524 |
| NRP1 | NM_003873.1 | FPr | CAGCTCTCTCCACGCGATTC | SEQ ID NO: 1525 |

TABLE A-continued

| Gene | Accession | Reagt | Sequence | SEQ ID NO |
|---|---|---|---|---|
| | | Probe | CAGGATCTACCCCGAGAGAGCCACTCAT | SEQ ID NO: 1526 |
| | | RPr | CCCAGCAGCTCCATTCTGA | SEQ ID NO: 1527 |
| NRP2 | NM_003872.1 | FPr | CTACAGCCTAAACGGCAAGG | SEQ ID NO: 1528 |
| | | Probe | AGGACCCCAGGACCCAGCAG | SEQ ID NO: 1529 |
| | | RPr | GTTCCCTTCGAACAGCTTTG | SEQ ID NO: 1530 |
| NTN1 | NM_004822.1 | FPr | AGAAGGACTATGCCGTCCAG | SEQ ID NO: 1531 |
| | | Probe | ATCCACATCCTGAAGGCGGACAAG | SEQ ID NO: 1532 |
| | | RPr | CCGTGAACTTCCACCAGTC | SEQ ID NO: 1533 |
| NUFIP1 | NM_012345.1 | FPr | GCTTCCACATCGTGGTATTG | SEQ ID NO: 1534 |
| | | Probe | CTTCTGATAGGTTTCCTCGGCATCAGA | SEQ ID NO: 1535 |
| | | RPr | AACTGCAGGGTTGAAGGACT | SEQ ID NO: 1536 |
| ODC1 | NM_002539.1 | FPr | AGAGATCACCGGCGTAATCAA | SEQ ID NO: 1537 |
| | | Probe | CCAGCGTTGGACAAATACTTTCCGTCA | SEQ ID NO: 1538 |
| | | RPr | CGGGCTCAGCTATGATTCTCA | SEQ ID NO: 1539 |
| OPN, osteopontin | NM_000582.1 | FPr | CAACCGAAGTTTTCACTCCAGTT | SEQ ID NO: 1540 |
| | | Probe | TCCCCACAGTAGACACATATGATGGCCG | SEQ ID NO: 1541 |
| | | RPr | CCTCAGTCCATAAACCACACTATCA | SEQ ID NO: 1542 |
| ORC1L | NM_004153.2 | FPr | TCCTTGACCATACCGGAGG | SEQ ID NO: 1543 |
| | | Probe | TGCATGTACATCTCCGGTGTCCCT | SEQ ID NO: 1544 |
| | | RPr | CAGTGGCAGTCTTCCCTGTC | SEQ ID NO: 1545 |
| OSM | NM_020530.3 | FPr | GTTTCTGAAGGGGAGGTCAC | SEQ ID NO: 1546 |
| | | Probe | CTGAGCTGGCCTCCTATGCCTCAT | SEQ ID NO: 1547 |
| | | RPr | AGGTGTCTGGTTTGGGACA | SEQ ID NO: 1548 |
| OSMR | NM_003999.1 | FPr | GCTCATCATGGTCATGTGCT | SEQ ID NO: 1549 |
| | | Probe | CAGGTCTCCTTGATCCACTGACTTTTCA | SEQ ID NO: 1550 |
| | | RPr | TGTAAGGGTCAGGGATGTCA | SEQ ID NO: 1551 |
| P14ARF | S78535.1 | FPr | CCCTCGTGCTGATGCTACT | SEQ ID NO: 1552 |
| | | Probe | CTGCCCTAGACGCTGGCTCCTC | SEQ ID NO: 1553 |
| | | RPr | CATCATGACCTGGTCTTCTAGG | SEQ ID NO: 1554 |
| p16-INK4 | L27211.1 | FPr | GCGGAAGGTCCCTCAGACA | SEQ ID NO: 1555 |
| | | Probe | CTCAGAGCCTCTCTGGTTCTTTCAATCGG | SEQ ID NO: 1556 |
| | | RPr | TGATGATCTAAGTTTCCCGAGGTT | SEQ ID NO: 1557 |
| p21 | NM_000389.1 | FPr | TGGAGACTCTCAGGGTCGAAA | SEQ ID NO: 1558 |
| | | Probe | CGGCGGCAGACCAGCATGAC | SEQ ID NO: 1559 |
| | | RPr | GGCGTTTGGAGTGGTAGAAATC | SEQ ID NO: 1560 |
| p27 | NM_004064.1 | FPr | CGGTGGACCACGAAGAGTTAA | SEQ ID NO: 1561 |
| | | Probe | CCGGGACTTGGAGAAGCACTGCA | SEQ ID NO: 1562 |
| | | RPr | GGCTCGCCTCTTCCATGTC | SEQ ID NO: 1563 |
| P53 | NM_000546.2 | FPr | CTTTGAACCCTTGCTTGCAA | SEQ ID NO: 1564 |
| | | Probe | AAGTCCTGGGTGCTTCTGACGCACA | SEQ ID NO: 1565 |
| | | RPr | CCCGGGACAAAGCAAATG | SEQ ID NO: 1566 |
| p53R2 | AB036063.1 | FPr | CCCAGCTAGTGTTCCTCAGA | SEQ ID NO: 1567 |
| | | Probe | TCGGCCAGCTTTTTCCAATCTTTG | SEQ ID NO: 1568 |
| | | RPr | CCGTAAGCCCTTCCTCTATG | SEQ ID NO: 1569 |
| PADI4 | NM_012387.1 | FPr | AGCAGTGGCTTGCTTTCTTC | SEQ ID NO: 1570 |
| | | Probe | CCTGTGATGTCCCAGTTTCCCACTC | SEQ ID NO: 1571 |
| | | RPr | TGCTAGGACCATGTTGGGAT | SEQ ID NO: 1572 |
| PAI1 | NM_000602.1 | FPr | CCGCAACGTGGTTTTCTCA | SEQ ID NO: 1573 |
| | | Probe | CTCGGTGTTGGCCATGCTCCAG | SEQ ID NO: 1574 |
| | | RPr | TGCTGGGTTTCTCCTCCTGTT | SEQ ID NO: 1575 |
| Pak1 | NM_002576.3 | FPr | GAGCTGTGGGTTGTTATGGA | SEQ ID NO: 1576 |
| | | Probe | ACATCTGTCAAGGAGCCTCCAGCC | SEQ ID NO: 1577 |
| | | RPr | CCATGCAAGTTTCTGTCACC | SEQ ID NO: 1578 |
| PARC | NM_015089.1 | FPr | GGAGCTGACCTGCTTCCTAC | SEQ ID NO: 1579 |
| | | Probe | TCCTTATGCATCGAGGCCAGGC | SEQ ID NO: 1580 |
| | | RPr | AGCAGAGCACCACAGCATAG | SEQ ID NO: 1581 |
| PCAF | NM_003884.3 | FPr | AGGTGGCTGTGTTACTGCAA | SEQ ID NO: 1582 |
| | | Probe | TGCCACAGTTCTGCGCACAGTCTACC | SEQ ID NO: 1583 |
| | | RPr | CACCTGTGTGGTTTCGTACC | SEQ ID NO: 1584 |

TABLE A-continued

| Gene | Accession | Reagt | Sequence | SEQ ID NO |
|------|-----------|-------|----------|-----------|
| PCNA | NM_002592.1 | FPr | GAAGGTGTTGGAGGCACTCAAG | SEQ ID NO: 1585 |
| | | Probe | ATCCCAGCAGGCCTCGTTGATGAG | SEQ ID NO: 1586 |
| | | RPr | GGTTTACACCGCTGGAGCTAA | SEQ ID NO: 1587 |
| PDGFA | NM_002607.2 | FPr | TTGTTGGTGTGCCCTGGTG | SEQ ID NO: 1588 |
| | | Probe | TGGTGGCGGTCACTCCCTCTGC | SEQ ID NO: 1589 |
| | | RPr | TGGGTTCTGTCCAAACACTGG | SEQ ID NO: 1590 |
| PDGFB | NM_002608.1 | FPr | ACTGAAGGAGACCCTTGGAG | SEQ ID NO: 1591 |
| | | Probe | TCTCCTGCCGATGCCCCTAGG | SEQ ID NO: 1592 |
| | | RPr | TAAATAACCCTGCCCACACA | SEQ ID NO: 1593 |
| PDGFC | NM_016205.1 | FPr | AGTTACTAAAAATACCACGAGGTCCTT | SEQ ID NO: 1594 |
| | | Probe | CCCTGACACCGGTCTTTGGTCTCAACT | SEQ ID NO: 1595 |
| | | RPr | GTCGGTGAGTGATTTGTGCAA | SEQ ID NO: 1596 |
| PDGFD | NM_025208.2 | FPr | TATCGAGGCAGGTCATACCA | SEQ ID NO: 1597 |
| | | Probe | TCCAGGTCAACTTTTGACTTCCGGT | SEQ ID NO: 1598 |
| | | RPr | TAACGCTTGGCATCATCATT | SEQ ID NO: 1599 |
| PDGFRa | NM_006206.2 | FPr | GGGAGTTTCCAAGAGATGGA | SEQ ID NO: 1600 |
| | | Probe | CCCAAGACCCGACCAAGCACTAG | SEQ ID NO: 1601 |
| | | RPr | CTTCAACCACCTTCCCAAAC | SEQ ID NO: 1602 |
| PDGFRb | NM_002609.2 | FPr | CCAGCTCTCCTTCCAGCTAC | SEQ ID NO: 1603 |
| | | Probe | ATCAATGTCCCTGTCCGAGTGCTG | SEQ ID NO: 1604 |
| | | RPr | GGGTGGCTCTCACTTAGCTC | SEQ ID NO: 1605 |
| PFN1 | NM_005022.2 | FPr | GGAAAACGTTCGTCAACATC | SEQ ID NO: 1606 |
| | | Probe | CAACCAGGACACCCACCTCAGCT | SEQ ID NO: 1607 |
| | | RPr | AAAACTTGACCGGTCTTTGC | SEQ ID NO: 1608 |
| PFN2 | NM_053024.1 | FPr | TCTATACGTCGATGGTGACTGC | SEQ ID NO: 1609 |
| | | Probe | CTCCCCACCTTGACTCTTTGTCCG | SEQ ID NO: 1610 |
| | | RPr | GCCGACAGCCACATTGTAT | SEQ ID NO: 1611 |
| PGK1 | NM_000291.1 | FPr | AGAGCCAGTTGCTGTAGAACTCAA | SEQ ID NO: 1612 |
| | | Probe | TCTCTGCTGGGCAAGGATGTTCTGTTC | SEQ ID NO: 1613 |
| | | RPr | CTGGGCCTACACAGTCCTTCA | SEQ ID NO: 1614 |
| PI3K | NM_002646.2 | FPr | TGCTACCTGGACAGCCCG | SEQ ID NO: 1615 |
| | | Probe | TCCTCCTGAAACGAGCTGTGTCTGACTT | SEQ ID NO: 1616 |
| | | RPr | AGGCCGTCCTTCAGTAACCA | SEQ ID NO: 1617 |
| PI3KC2A | NM_002645.1 | FPr | ATACCAATCACCGCACAAACC | SEQ ID NO: 1618 |
| | | Probe | TGCGCTGTGACTGGACTTAACAAATAGCCT | SEQ ID NO: 1619 |
| | | RPr | CACACTAGCATTTTCTCCGCATA | SEQ ID NO: 1620 |
| PIK3CA | NM_006218.1 | FPr | GTGATTGAAGAGCATGCCAA | SEQ ID NO: 1621 |
| | | Probe | TCCTGCTTCTCGGGATACAGACCA | SEQ ID NO: 1622 |
| | | RPr | GTCCTGCGTGGGAATAGC | SEQ ID NO: 1623 |
| PIM1 | NM_002648.2 | FPr | CTGCTCAAGGACACCGTCTA | SEQ ID NO: 1624 |
| | | Probe | TACACTCGGGTCCCATCGAAGTCC | SEQ ID NO: 1625 |
| | | RPr | GGATCCACTCTGGAGGGC | SEQ ID NO: 1626 |
| Pin1 | NM_006221.1 | FPr | GATCAACGGCTACATCCAGA | SEQ ID NO: 1627 |
| | | Probe | TCAAAGTCCTCCTCTCCCGACTTGA | SEQ ID NO: 1628 |
| | | RPr | TGAACTGTGAGGCCAGAGAC | SEQ ID NO: 1629 |
| PKD1 | NM_000296.2 | FPr | CAGCACCAGCGATTACGAC | SEQ ID NO: 1630 |
| | | Probe | AGCCATTGTGAGGACTCTCCCAGC | SEQ ID NO: 1631 |
| | | RPr | CTGAATAGGCCCACGTCC | SEQ ID NO: 1632 |
| PKR2 | NM_002654.3 | FPr | CCGCCTGGACATTGATTCAC | SEQ ID NO: 1633 |
| | | Probe | ACCCATCACAGCCCGGAACACTG | SEQ ID NO: 1634 |
| | | RPr | CTGGGCCAATGGTACAGATGA | SEQ ID NO: 1635 |
| PLA2G2A | NM_000300.2 | FPr | GCATCCCTCACCCATCCTA | SEQ ID NO: 1636 |
| | | Probe | AGGCCAGGCAGGAGCCCTTCTATA | SEQ ID NO: 1637 |
| | | RPr | GCTGGAAATCTGCTGGATGT | SEQ ID NO: 1638 |
| PLAUR | NM_002659.1 | FPr | CCCATGGATGCTCCTCTGAA | SEQ ID NO: 1639 |
| | | Probe | CATTGACTGCCGAGGCCCCATG | SEQ ID NO: 1640 |
| | | RPr | CCGGTGGCTACCAGACATTG | SEQ ID NO: 1641 |

TABLE A-continued

| Gene | Accession | Reagt | Sequence | SEQ ID NO |
|---|---|---|---|---|
| PLK | NM_005030.2 | FPr | AATGAATACAGTATTCCCAAGCACAT | SEQ ID NO: 1642 |
| | | Probe | AACCCCGTGGCCGCCTCC | SEQ ID NO: 1643 |
| | | RPr | TGTCTGAAGCATCTTCTGGATGA | SEQ ID NO: 1644 |
| PLK3 | NM_004073.2 | FPr | TGAAGGAGACGTACCGCTG | SEQ ID NO: 1645 |
| | | Probe | CAAGCAGGTTCACTACACGCTGCC | SEQ ID NO: 1646 |
| | | RPr | CAGGCAGTGAGAGGCTGG | SEQ ID NO: 1647 |
| PLOD2 | NM_000935.2 | FPr | CAGGGAGGTGGTTGCAAAT | SEQ ID NO: 1648 |
| | | Probe | TCCAGCCTTTTCGTGGTGACTCAA | SEQ ID NO: 1649 |
| | | RPr | TCTCCCAGGATGCATGAAG | SEQ ID NO: 1650 |
| PMS1 | NM_000534.2 | FPr | CTTACGGTTTTCGTGGAGAAG | SEQ ID NO: 1651 |
| | | Probe | CCTCAGCTATACAACAAATTGACCCCAAG | SEQ ID NO: 1652 |
| | | RPr | AGCAGCCGTTCTTGTTGTAA | SEQ ID NO: 1653 |
| PMS2 | NM_000535.2 | FPr | GATGTGGACTGCCATTCAAA | SEQ ID NO: 1654 |
| | | Probe | TCGAAATTTACATCCGGTATCTTCCTGG | SEQ ID NO: 1655 |
| | | RPr | TGCGAGATTAGTTGGCTGAG | SEQ ID NO: 1656 |
| PPARG | NM_005037.3 | FPr | TGACTTTATGGAGCCCAAGTT | SEQ ID NO: 1657 |
| | | Probe | TTCCAGTGCATTGAACTTCACAGCA | SEQ ID NO: 1658 |
| | | RPr | GCCAAGTCGCTGTCATCTAA | SEQ ID NO: 1659 |
| PPID | NM_005038.1 | FPr | TCCTCATTTGGATGGGAAAC | SEQ ID NO: 1660 |
| | | Probe | TTCCTTTAATTACTTGGCCAAACACCACA | SEQ ID NO: 1661 |
| | | RPr | CCAATATCCTTGCCACTCCTA | SEQ ID NO: 1662 |
| PPM1D | NM_003620.1 | FPr | GCCATCCGCAAAGGCTTT | SEQ ID NO: 1663 |
| | | Probe | TCGCTTGTCACCTTGCCATGTGG | SEQ ID NO: 1664 |
| | | RPr | GGCCATTCCGCCAGTTTC | SEQ ID NO: 1665 |
| PPP2R4 | NM_178001.1 | FPr | GGCTCAGAGCATAAGGCTTC | SEQ ID NO: 1666 |
| | | Probe | TTGGTCACTTCTCCCAACTTGGGC | SEQ ID NO: 1667 |
| | | RPr | ACGGGAACTCAGAAAACTGG | SEQ ID NO: 1668 |
| PR | NM_000926.2 | FPr | GCATCAGGCTGTCATTATGG | SEQ ID NO: 1669 |
| | | Probe | TGTCCTTACCTGTGGGAGCTGTAAGGTC | SEQ ID NO: 1670 |
| | | RPr | AGTAGTTGTGCTGCCCTTCC | SEQ ID NO: 1671 |
| PRDX2 | NM_005809.4 | FPr | GGTGTCCTTCGCCAGATCAC | SEQ ID NO: 1672 |
| | | Probe | TTAATGATTTGCCTGTGGGACGCTCC | SEQ ID NO: 1673 |
| | | RPr | CAGCCGCAGAGCCTCATC | SEQ ID NO: 1674 |
| PRDX3 | NM_006793.2 | FPr | TGACCCCAATGGAGTCATCA | SEQ ID NO: 1675 |
| | | Probe | CATTTGAGCGTCAACGATCTCCCAGTG | SEQ ID NO: 1676 |
| | | RPr | CCAAGCGGAGGGTTTCTTC | SEQ ID NO: 1677 |
| PRDX4 | NM_006406.1 | FPr | TTACCCATTTGGCCTGGATTAA | SEQ ID NO: 1678 |
| | | Probe | CCAAGTCCTCCTTGTCTTCGAGGGGT | SEQ ID NO: 1679 |
| | | RPr | CTGAAAGAAGTGGAATCCTTATTGG | SEQ ID NO: 1680 |
| PRDX6 | NM_004905.2 | FPr | CTGTGAGCCAGAGGATGTCA | SEQ ID NO: 1681 |
| | | Probe | CTGCCAATTGTGTTTTCCTGCAGC | SEQ ID NO: 1682 |
| | | RPr | TGTGATGACACCAGGATGTG | SEQ ID NO: 1683 |
| PRKCA | NM_002737.1 | FPr | CAAGCAATGCGTCATCAATGT | SEQ ID NO: 1684 |
| | | Probe | CAGCCTCTGCGGAATGGATCACACT | SEQ ID NO: 1685 |
| | | RPr | GTAAATCCGCCCCCTCTTCT | SEQ ID NO: 1686 |
| PRKCB1 | NM_002738.5 | FPr | GACCCAGCTCCACTCCTG | SEQ ID NO: 1687 |
| | | Probe | CCAGACCATGGACCGCCTGTACTT | SEQ ID NO: 1688 |
| | | RPr | CCCATTCACGTACTCCATCA | SEQ ID NO: 1689 |
| PRKCD | NM_006254.1 | FPr | CTGACACTTGCCGCAGAGAA | SEQ ID NO: 1690 |
| | | Probe | CCCTTTCTCACCCACCTCATCTGCAC | SEQ ID NO: 1691 |
| | | RPr | AGGTGGTCCTTGGTCTGGAA | SEQ ID NO: 1692 |
| PRKR | NM_002759.1 | FPr | GCGATACATGAGCCCAGAACA | SEQ ID NO: 1693 |
| | | Probe | AGGTCCACTTCCTTTCCATAGTCTTGCGA | SEQ ID NO: 1694 |
| | | RPr | TCAGCAAGAATTAGCCCCAAAG | SEQ ID NO: 1695 |
| pS2 | NM_003225.1 | FPr | GCCCTCCCAGTGTGCAAAT | SEQ ID NO: 1696 |
| | | Probe | TGCTGTTTCGACGACACCGTTCG | SEQ ID NO: 1697 |
| | | RPr | CGTCGATGGTATTAGGATAGAAGCA | SEQ ID NO: 1698 |
| PTCH | NM_000264.2 | FPr | CCACGACAAAGCCGACTAC | SEQ ID NO: 1699 |
| | | Probe | CCTGAAACAAGGCTGAGAATCCCG | SEQ ID NO: 1700 |

TABLE A-continued

| Gene | Accession | Reagt | Sequence | SEQ ID NO |
|---|---|---|---|---|
| | | RPr | TACTCGATGGGCTCTGCTG | SEQ ID NO: 1701 |
| PTEN | NM_000314.1 | FPr | TGGCTAAGTGAAGATGACAATCATG | SEQ ID NO: 1702 |
| | | Probe | CCTTTCCAGCTTTACAGTGAATTGCTGCA | SEQ ID NO: 1703 |
| | | RPr | TGCACATATCATTACACCAGTTCGT | SEQ ID NO: 1704 |
| PTGER3 | NM_000957.2 | FPr | TAACTGGGGCAACCTTTTCT | SEQ ID NO: 1705 |
| | | Probe | CCTTTGCCTTCCTGGGGCTCTT | SEQ ID NO: 1706 |
| | | RPr | TTGCAGGAAAAGGTGACTGT | SEQ ID NO: 1707 |
| PTHLH | NM_002820.1 | FPr | AGTGACTGGGAGTGGGCTAGAA | SEQ ID NO: 1708 |
| | | Probe | TGACACCTCCACAACGTCGCTGGA | SEQ ID NO: 1709 |
| | | RPr | AAGCCTGTTACCGTGAATCGA | SEQ ID NO: 1710 |
| PTHR1 | NM_000316.1 | FPr | CGAGGTACAAGCTGAGATCAAGAA | SEQ ID NO: 1711 |
| | | Probe | CCAGTGCCAGTGTCCAGCGGCT | SEQ ID NO: 1712 |
| | | RPr | GCGTGCCTTTCGCTTGAA | SEQ ID NO: 1713 |
| PTK2 | NM_005607.3 | FPr | GACCGGTCGAATGATAAGGT | SEQ ID NO: 1714 |
| | | Probe | ACCAGGCCCGTCACATTCTCGTAC | SEQ ID NO: 1715 |
| | | RPr | CTGGACATCTCGATGACAGC | SEQ ID NO: 1716 |
| PTK2B | NM_004103.3 | FPr | CAAGCCCAGCCGACCTAAG | SEQ ID NO: 1717 |
| | | Probe | CTCCGCAAACCAACCTCCTGGCT | SEQ ID NO: 1718 |
| | | RPr | GAACCTGGAACTGCAGCTTTG | SEQ ID NO: 1719 |
| PTP4A3 | NM_007079.2 | FPr | CCTGTTCTCGGCACCTTAAA | SEQ ID NO: 1720 |
| | | Probe | ACCTGACTGCCCCGGGGTCTAATA | SEQ ID NO: 1721 |
| | | RPr | TATTGCCTTCGGGTGTCC | SEQ ID NO: 1722 |
| PTP4A3 v2 | NM_032611.1 | FPr | AATATTTGTGCGGGGTATGG | SEQ ID NO: 1723 |
| | | Probe | CCAAGAGAAACGAGATTTAAAAACCCACC | SEQ ID NO: 1724 |
| | | RPr | AACGAGATCCCTGTGCTTGT | SEQ ID NO: 1725 |
| PTPD1 | NM_007039.2 | FPr | CGCTTGCCTAACTCATACTTTCC | SEQ ID NO: 1726 |
| | | Probe | TCCACGCAGCGTGGCACTG | SEQ ID NO: 1727 |
| | | RPr | CCATTCAGACTGCGCCACTT | SEQ ID NO: 1728 |
| PTPN1 | NM_002827.2 | FPr | AATGAGGAAGTTTCGGATGG | SEQ ID NO: 1729 |
| | | Probe | CTGATCCAGACAGCCGACCAGCT | SEQ ID NO: 1730 |
| | | RPr | CTTCGATCACAGCCAGGTAG | SEQ ID NO: 1731 |
| PTPRF | NM_002840.2 | FPr | TGTTTTAGCTGAGGGACGTG | SEQ ID NO: 1732 |
| | | Probe | CCGACGTCCCCAAACCTAGCTAGG | SEQ ID NO: 1733 |
| | | RPr | TACCAACCCTGGAATGTTGA | SEQ ID NO: 1734 |
| PTPRJ | NM_002843.2 | FPr | AACTTCCGGTACCTCGTTCGT | SEQ ID NO: 1735 |
| | | Probe | ACTACATGAAGCAGAGTCCTCCCGAATCG | SEQ ID NO: 1736 |
| | | RPr | AGCACTGCAATGCACCAGAA | SEQ ID NO: 1737 |
| PTPRO | NM_030667.1 | FPr | CATGGCCTGATCATGGTGT | SEQ ID NO: 1738 |
| | | Probe | CCCACAGCAAATGCTGCAGAAAGT | SEQ ID NO: 1739 |
| | | RPr | CCATGTGTACAAACTGCAGGA | SEQ ID NO: 1740 |
| PTTG1 | NM_004219.2 | FPr | GGCTACTCTGATCTATGTTGATAAGGAA | SEQ ID NO: 1741 |
| | | Probe | CACACGGGTGCCTGGTTCTCCA | SEQ ID NO: 1742 |
| | | RPr | GCTTCAGCCCATCCTTAGCA | SEQ ID NO: 1743 |
| RAB32 | NM_006834.2 | FPr | CCTGCAGCTGTGGGACAT | SEQ ID NO: 1744 |
| | | Probe | CGATTTGGCAACATGACCCGAGTA | SEQ ID NO: 1745 |
| | | RPr | AGCACCAACAGCTTCCTTG | SEQ ID NO: 1746 |
| RAB6C | NM_032144.1 | FPr | GCGACAGCTCCTCTAGTTCCA | SEQ ID NO: 1747 |
| | | Probe | TTCCCGAAGTCTCCGCCCG | SEQ ID NO: 1748 |
| | | RPr | GGAACACCAGCTTGAATTTCCT | SEQ ID NO: 1749 |
| RAC1 | NM_006908.3 | FPr | TGTTGTAAATGTCTCAGCCCC | SEQ ID NO: 1750 |
| | | Probe | CGTTCTTGGTCCTGTCCCTTGA | SEQ ID NO: 1751 |
| | | RPr | TTGAGCAAAGCGTACAAAGG | SEQ ID NO: 1752 |
| RAD51C | NM_058216.1 | FPr | GAACTTCTTGAGCAGGAGCATACC | SEQ ID NO: 1753 |
| | | Probe | AGGGCTTCATAATCACCTTCTGTTC | SEQ ID NO: 1754 |
| | | RPr | TCCACCCCCAAGAATATCATCTAGT | SEQ ID NO: 1755 |
| RAD54L | NM_003579.2 | FPr | AGCTAGCCTCAGTGACACACATG | SEQ ID NO: 1756 |
| | | Probe | ACACAACGTCGGCAGTGCAACCTG | SEQ ID NO: 1757 |
| | | RPr | CCGGATCTGACGGCTGTT | SEQ ID NO: 1758 |

TABLE A-continued

| Gene | Accession | Reagt | Sequence | SEQ ID NO |
|---|---|---|---|---|
| RAF1 | NM_002880.1 | FPr | CGTCGTATGCGAGAGTCTGT | SEQ ID NO: 1759 |
| | | Probe | TCCAGGATGCCTGTTAGTTCTCAGCA | SEQ ID NO: 1760 |
| | | RPr | TGAAGGCGTGAGGTGTAGAA | SEQ ID NO: 1761 |
| RALBP1 | NM_006788.2 | FPr | GGTGTCAGATATAAATGTGCAAATGC | SEQ ID NO: 1762 |
| | | Probe | TGCTGTCCTGTCGGTCTCAGTACGTTCA | SEQ ID NO: 1763 |
| | | RPr | TTCGATATTGCCAGCAGCTATAAA | SEQ ID NO: 1764 |
| RANBP2 | NM_006267.3 | FPr | TCCTTCAGCTTTCACACTGG | SEQ ID NO: 1765 |
| | | Probe | TCCAGAAGAGTCATGCAACTTCATTTCTG | SEQ ID NO: 1766 |
| | | RPr | AAATCCTGTTCCCACCTGAC | SEQ ID NO: 1767 |
| ranBP7 | NM_006391.1 | FPr | AACATGATTATCCAAGCCGC | SEQ ID NO: 1768 |
| | | Probe | AAGCCAATTTTGTCCACAATGGCA | SEQ ID NO: 1769 |
| | | RPr | GCCAACAAGCACTGTTATCG | SEQ ID NO: 1770 |
| RANBP9 | NM_005493.2 | FPr | CAAGTCAGTTGAGACGCCAGTT | SEQ ID NO: 1771 |
| | | Probe | TTCTATGGCGGCCTGACTTCCTCCA | SEQ ID NO: 1772 |
| | | RPr | TGCAGCTCTCGTCCAAAGTG | SEQ ID NO: 1773 |
| RAP1GDS1 | NM_021159.3 | FPr | TGTGGATGCTGGATTGATTT | SEQ ID NO: 1774 |
| | | Probe | CCACTGGTGCAGCTGCTAAATAGCA | SEQ ID NO: 1775 |
| | | RPr | AAGCAGCACTTCCTGGTCTT | SEQ ID NO: 1776 |
| RARA | NM_000964.1 | FPr | AGTCTGTGAGAAACGACCGAAAC | SEQ ID NO: 1777 |
| | | Probe | TCGGGCTTGGGCACCTCCTTCTT | SEQ ID NO: 1778 |
| | | RPr | CGGCGTCAGCGTGTAGCT | SEQ ID NO: 1779 |
| RARB | NM_016152.2 | FPr | TGCCTGGACATCCTGATTCT | SEQ ID NO: 1780 |
| | | Probe | TGCACCAGGTATACCCCAGAACAAGA | SEQ ID NO: 1781 |
| | | RPr | AAGGCCGTCTGAGAAAGTCA | SEQ ID NO: 1782 |
| RASSF1 | NM_007182.3 | FPr | AGTGGGAGACACCTGACCTT | SEQ ID NO: 1783 |
| | | Probe | TTGATCTTCTGCTCAATCTCAGCTTGAGA | SEQ ID NO: 1784 |
| | | RPr | TGATCTGGGCATTGTACTCC | SEQ ID NO: 1785 |
| RBM5 | NM_005778.1 | FPr | CGAGAGGGAGAGCAAGACCAT | SEQ ID NO: 1786 |
| | | Probe | CTGCGCGGCCTTCCCATCA | SEQ ID NO: 1787 |
| | | RPr | TCTCGAATATCGCTCTCTGTGATG | SEQ ID NO: 1788 |
| RBX1 | NM_014248.2 | FPr | GGAACCACATTATGGATCTTTGC | SEQ ID NO: 1789 |
| | | Probe | TAGAATGTCAAGCTAACCAGGCGTCCGC | SEQ ID NO: 1790 |
| | | RPr | CATGCGACAGTACACTCTTCTGAA | SEQ ID NO: 1791 |
| RCC1 | NM_001269.2 | FPr | GGGCTGGGTGAGAATGTG | SEQ ID NO: 1792 |
| | | Probe | ATACCAGGGCCGGCTTCTTCCTCT | SEQ ID NO: 1793 |
| | | RPr | CACAACATCCTCCGGAATG | SEQ ID NO: 1794 |
| REG4 | NM_032044.2 | FPr | TGCTAACTCCTGCACAGCC | SEQ ID NO: 1795 |
| | | Probe | TCCTCTTCCTTTCTGCTAGCCTGGC | SEQ ID NO: 1796 |
| | | RPr | TGCTAGGTTTCCCCTCTGAA | SEQ ID NO: 1797 |
| RFC | NM_003056.1 | FPr | TCAAGACCATCATCACTTTCATTGT | SEQ ID NO: 1798 |
| | | Probe | CCTCCCGGTCCGCAAGCAGTT | SEQ ID NO: 1799 |
| | | RPr | GGATCAGGAAGTACACGGAGTATAACT | SEQ ID NO: 1800 |
| RhoB | NM_004040.2 | FPr | AAGCATGAACAGGACTTGACC | SEQ ID NO: 1801 |
| | | Probe | CTTTCCAACCCCTGGGGAAGACAT | SEQ ID NO: 1802 |
| | | RPr | CCTCCCCAAGTCAGTTGC | SEQ ID NO: 1803 |
| rhoC | NM_175744.1 | FPr | CCCGTTCGGTCTGAGGAA | SEQ ID NO: 1804 |
| | | Probe | TCCGGTTCGCCATGTCCCG | SEQ ID NO: 1805 |
| | | RPr | GAGCACTCAAGGTAGCCAAAGG | SEQ ID NO: 1806 |
| RIZ1 | NM_012231.1 | FPr | CCAGACGAGCGATTAGAAGC | SEQ ID NO: 1807 |
| | | Probe | TGTGAGGTGAATGATTTGGGGGA | SEQ ID NO: 1808 |
| | | RPr | TCCTCCTCTTCCTCCTCCTC | SEQ ID NO: 1809 |
| RNF11 | NM_014372.3 | FPr | ACCCTGGAAGAGATGGATCA | SEQ ID NO: 1810 |
| | | Probe | CCATCATACAGATCACACACTCCCGG | SEQ ID NO: 1811 |
| | | RPr | ATTGGGTCCCCATAAACAAA | SEQ ID NO: 1812 |
| ROCK1 | NM_005406.1 | FPr | TGTGCACATAGGAATGAGCTTC | SEQ ID NO: 1813 |
| | | Probe | TCACTCTCTTTGCTGGCCAACTGC | SEQ ID NO: 1814 |
| | | RPr | GTTTAGCACGCAATTGCTCA | SEQ ID NO: 1815 |
| ROCK2 | NM_004850.3 | FPr | GATCCGAGACCCTCGCTC | SEQ ID NO: 1816 |

TABLE A-continued

| Gene | Accession | Reagt | Sequence | SEQ ID NO |
|------|-----------|-------|----------|-----------|
| | | Probe | CCCATCAACGTGGAGAGCTTGCT | SEQ ID NO: 1817 |
| | | RPr | AGGACCAAGGAATTTAAGCCA | SEQ ID NO: 1818 |
| RPLPO | NM_001002.2 | FPr | CCATTCTATCATCAACGGGTACAA | SEQ ID NO: 1819 |
| | | Probe | TCTCCACAGACAAGGCCAGGACTCG | SEQ ID NO: 1820 |
| | | RPr | TCAGCAAGTGGGAAGGTGTAATC | SEQ ID NO: 1821 |
| RPS13 | NM_001017.2 | FPr | CAGTCGGCTTTACCCTATCG | SEQ ID NO: 1822 |
| | | Probe | CAACTTCAACCAAGTGGGGACGCT | SEQ ID NO: 1823 |
| | | RPr | TCTGCTCCTTCACGTCGTC | SEQ ID NO: 1824 |
| RRM1 | NM_001033.1 | FPr | GGGCTACTGGCAGCTACATT | SEQ ID NO: 1825 |
| | | Probe | CATTGGAATTGCCATTAGTCCCAGC | SEQ ID NO: 1826 |
| | | RPr | CTCTCAGCATCGGTACAAGG | SEQ ID NO: 1827 |
| RRM2 | NM_001034.1 | FPr | CAGCGGGATTAAACAGTCCT | SEQ ID NO: 1828 |
| | | Probe | CCAGCACAGCCAGTTAAAAGATGCA | SEQ ID NO: 1829 |
| | | RPr | ATCTGCGTTGAAGCAGTGAG | SEQ ID NO: 1830 |
| RTN4 | NM_007008.1 | FPr | GACTGGAGTGGTGTTTGGTG | SEQ ID NO: 1831 |
| | | Probe | CCAGCCTATTCCTGCTGCTTTCATTG | SEQ ID NO: 1832 |
| | | RPr | CTGTTACGCTCACAATGCTG | SEQ ID NO: 1833 |
| RUNX1 | NM_001754.2 | FPr | AACAGAGACATTGCCAACCA | SEQ ID NO: 1834 |
| | | Probe | TTGGATCTGCTTGCTGTCCAAACC | SEQ ID NO: 1835 |
| | | RPr | GTGATTTGCCCAGGAAGTTT | SEQ ID NO: 1836 |
| RXRA | NM_002957.3 | FPr | GCTCTGTTGTGTCCTGTTGC | SEQ ID NO: 1837 |
| | | Probe | TCAGTCACAGGAAGGCCAGAGCC | SEQ ID NO: 1838 |
| | | RPr | GTACGGAGAAGCCACTTCACA | SEQ ID NO: 1839 |
| S100A1 | NM_006271.1 | FPr | TGGACAAGGTGATGAAGGAG | SEQ ID NO: 1840 |
| | | Probe | CCTCCCCGTCTCCATTCTCGTCTA | SEQ ID NO: 1841 |
| | | RPr | AGCACCACATACTCCTGGAA | SEQ ID NO: 1842 |
| S100A2 | NM_005978.2 | FPr | TGGCTGTGCTGGTCACTACCT | SEQ ID NO: 1843 |
| | | Probe | CACAAGTACTCCTGCCAAGAGGGCGAC | SEQ ID NO: 1844 |
| | | RPr | TCCCCCTTACTCAGCTTGAACT | SEQ ID NO: 1845 |
| S100A4 | NM_002961.2 | FPr | GACTGCTGTCATGGCGTG | SEQ ID NO: 1846 |
| | | Probe | ATCACATCCAGGGCCTTCTCCAGA | SEQ ID NO: 1847 |
| | | RPr | CGAGTACTTGTGGAAGGTGGAC | SEQ ID NO: 1848 |
| S100A8 | NM_002964.3 | FPr | ACTCCCTGATAAAGGGGAATTT | SEQ ID NO: 1849 |
| | | Probe | CATGCCGTCTACAGGGATGACCTG | SEQ ID NO: 1850 |
| | | RPr | TGAGGACACTCGGTCTCTAGC | SEQ ID NO: 1851 |
| S100A9 | NM_002965.2 | FPr | CTTTGGGACAGAGTGCAAGA | SEQ ID NO: 1852 |
| | | Probe | CGATGACTTGCAAAATGTCGCAGC | SEQ ID NO: 1853 |
| | | RPr | TGGTCTCTATGTTGCGTTCC | SEQ ID NO: 1854 |
| S100P | NM_005980.2 | FPr | AGACAAGGATGCCGTGGATAA | SEQ ID NO: 1855 |
| | | Probe | TTGCTCAAGGACCTGGACGCCAA | SEQ ID NO: 1856 |
| | | RPr | GAAGTCCACCTGGGCATCTC | SEQ ID NO: 1857 |
| SAT | NM_002970.1 | FPr | CCTTTTACCACTGCCTGGTT | SEQ ID NO: 1858 |
| | | Probe | TCCAGTGCTCTTTCGGCACTTCTG | SEQ ID NO: 1859 |
| | | RPr | ACAATGCTGTGTCCTTCCG | SEQ ID NO: 1860 |
| SBA2 | NM_018639.3 | FPr | GGACTCAACGATGGGCAG | SEQ ID NO: 1861 |
| | | Probe | CCCTGTCTGCACCTCCCAGATCTT | SEQ ID NO: 1862 |
| | | RPr | CGGAAAGATTCAAAAGCAGG | SEQ ID NO: 1863 |
| SDC1 | NM_002997.1 | FPr | GAAATTGACGAGGGGTGTCT | SEQ ID NO: 1864 |
| | | Probe | CTCTGAGCGCCTCCATCCAAGG | SEQ ID NO: 1865 |
| | | RPr | AGGAGCTAACGGAGAACCTG | SEQ ID NO: 1866 |
| SEMA3B | NM_004636.1 | FPr | GCTCCAGGATGTGTTTCTGTTG | SEQ ID NO: 1867 |
| | | Probe | TCGCGGGACCACCGGACC | SEQ ID NO: 1868 |
| | | RPr | ACGTGGAGAAGACGGCATAGA | SEQ ID NO: 1869 |
| SEMA3F | NM_004186.1 | FPr | CGCGAGCCCCTCATTATACA | SEQ ID NO: 1870 |
| | | Probe | CTCCCCACAGCGCATCGAGGAA | SEQ ID NO: 1871 |
| | | RPr | CACTCGCCGTTGACATCCT | SEQ ID NO: 1872 |
| SEMA4B | NM_020210.1 | FPr | TTCCAGCCCAACACAGTGAA | SEQ ID NO: 1873 |
| | | Probe | ACTTTGGCCTGCCCGCTCCTCT | SEQ ID NO: 1874 |
| | | RPr | GAGTCGGGTCGCCAGGTT | SEQ ID NO: 1875 |

TABLE A-continued

| Gene | Accession | Reagt | Sequence | SEQ ID NO |
|---|---|---|---|---|
| SFRP2 | NM_003013.2 | FPr | CAAGCTGAACGGTGTGTCC | SEQ ID NO: 1876 |
| | | Probe | CAGCACCGATTTCTTCAGGTCCCT | SEQ ID NO: 1877 |
| | | RPr | TGCAAGCTGTCTTTGAGCC | SEQ ID NO: 1878 |
| SFRP4 | NM_003014.2 | FPr | TACAGGATGAGGCTGGGC | SEQ ID NO: 1879 |
| | | Probe | CCTGGGACAGCCTATGTAAGGCCA | SEQ ID NO: 1880 |
| | | RPr | GTTGTTAGGGCAAGGGGC | SEQ ID NO: 1881 |
| SGCB | NM_000232.1 | FPr | CAGTGGAGACCAGTTGGGTAGTG | SEQ ID NO: 1882 |
| | | Probe | CACACATGCAGAGCTTGTAGCGTACCCA | SEQ ID NO: 1883 |
| | | RPr | CCTTGAAGAGCGTCCCATCA | SEQ ID NO: 1884 |
| SHC1 | NM_003029.3 | FPr | CCAACACCTTCTTGGCTTCT | SEQ ID NO: 1885 |
| | | Probe | CCTGTGTTCTTGCTGAGCACCCTC | SEQ ID NO: 1886 |
| | | RPr | CTGTTATCCCAACCCAAACC | SEQ ID NO: 1887 |
| SHH | NM_000193.2 | FPr | GTCCAAGGCACATATCCACTG | SEQ ID NO: 1888 |
| | | Probe | CACCGAGTTCTCTGCTTTCACCGA | SEQ ID NO: 1889 |
| | | RPr | GAAGCAGCCTCCCGATTT | SEQ ID NO: 1890 |
| SI | NM_001041.1 | FPr | AACGGACTCCCTCAATTTGT | SEQ ID NO: 1891 |
| | | Probe | TGTCCATGGTCATGCAAATCTTGC | SEQ ID NO: 1892 |
| | | RPr | GAAATTGCAGGGTCCAAGAT | SEQ ID NO: 1893 |
| Siah-1 | NM_003031.2 | FPr | TTGGCATTGGAACTACATTCA | SEQ ID NO: 1894 |
| | | Probe | TCCGCGGTATCCTCGGATTAGTTC | SEQ ID NO: 1895 |
| | | RPr | GGTATGGAGAAGGGGGTCC | SEQ ID NO: 1896 |
| SIAT4A | NM_003033.2 | FPr | AACCACAGTTGGAGGAGGAC | SEQ ID NO: 1897 |
| | | Probe | CAGAGACAGTTTCCCTCCCCGCT | SEQ ID NO: 1898 |
| | | RPr | CGAAGGAAGGGTGTTGGTAT | SEQ ID NO: 1899 |
| SIAT7B | NM_006456.1 | FPr | TCCAGCCCAAATCCTCCT | SEQ ID NO: 1900 |
| | | Probe | TGGCACATCCTACCCCAGATGCTA | SEQ ID NO: 1901 |
| | | RPr | GGTGTCCTGGAGTCCTTGAA | SEQ ID NO: 1902 |
| SIM2 | NM_005069.2 | FPr | GATGGTAGGAAGGGATGTGC | SEQ ID NO: 1903 |
| | | Probe | CGCCTCTCCACGCACTCAGCTAT | SEQ ID NO: 1904 |
| | | RPr | CACAAGGAGCTGTGAATGAGG | SEQ ID NO: 1905 |
| SIN3A | NM_015477.1 | FPr | CCAGAGTCATGCTCATCCAG | SEQ ID NO: 1906 |
| | | Probe | CTGTCCCTGCACTGGTGCAACTG | SEQ ID NO: 1907 |
| | | RPr | CCACCTTCAGCCTCTGAAAT | SEQ ID NO: 1908 |
| SIR2 | NM_012238.3 | FPr | AGCTGGGGTGTCTGTTTCAT | SEQ ID NO: 1909 |
| | | Probe | CCTGACTTCAGGTCAAGGGATGG | SEQ ID NO: 1910 |
| | | RPr | ACAGCAAGGCGAGCATAAAT | SEQ ID NO: 1911 |
| SKP1A | NM_006930.2 | FPr | CCATTGCCTTTGCTTTGTTCAT | SEQ ID NO: 1912 |
| | | Probe | TCCCATGGTTTTTATTCTGCCCTGCTG | SEQ ID NO: 1913 |
| | | RPr | TTCCGGATTTCCTTTCTTTGC | SEQ ID NO: 1914 |
| SKP2 | NM_005983.2 | FPr | AGTTGCAGAATCTAAGCCTGGAA | SEQ ID NO: 1915 |
| | | Probe | CCTGCGGCTTTCGGATCCCA | SEQ ID NO: 1916 |
| | | RPr | TGAGTTTTTTGCGAGAGTATTGACA | SEQ ID NO: 1917 |
| SLC25A3 | NM_213611.1 | FPr | TCTGCCAGTGCTGAATTCTT | SEQ ID NO: 1918 |
| | | Probe | TGCTGACATTGCCCTGGCTCCTAT | SEQ ID NO: 1919 |
| | | RPr | TTCGAACCTTAGCAGCTTCC | SEQ ID NO: 1920 |
| SLC2A1 | NM_006516.1 | FPr | GCCTGAGTCTCCTGTGCC | SEQ ID NO: 1921 |
| | | Probe | ACATCCCAGGCTTCACCCTGAATG | SEQ ID NO: 1922 |
| | | RPr | AGTCTCCACCCTCAGGCAT | SEQ ID NO: 1923 |
| SLC31A1 | NM_001859.2 | FPr | CCGTTCGAAGAGTCGTGAG | SEQ ID NO: 1924 |
| | | Probe | TCTCCGAATCTTAACCCGTCACCC | SEQ ID NO: 1925 |
| | | RPr | AGTCCAGCCACTAGCACCTC | SEQ ID NO: 1926 |
| SLC5A8 | NM_145913.2 | FPr | CCTGCTTTCAACCACATTGA | SEQ ID NO: 1927 |
| | | Probe | TCCCATTGCTCTTGCCACTCTGAT | SEQ ID NO: 1928 |
| | | RPr | AGAGCAGCTTCACAAACGAG | SEQ ID NO: 1929 |
| SLC7A5 | NM_003486.4 | FPr | GCGCAGAGGCCAGTTAAA | SEQ ID NO: 1930 |
| | | Probe | AGATCACCTCCTCGAACCCACTCC | SEQ ID NO: 1931 |
| | | RPr | AGCTGAGCTGTGGGTTGC | SEQ ID NO: 1932 |
| SLPI | NM_003064.2 | FPr | ATGGCCAATGTTTGATGCT | SEQ ID NO: 1933 |

TABLE A-continued

| Gene | Accession | Reagt | Sequence | SEQ ID NO |
|---|---|---|---|---|
| | | Probe | TGGCCATCCATCTCACAGAAATTGG | SEQ ID NO: 1934 |
| | | RPr | ACACTTCAAGTCACGCTTGC | SEQ ID NO: 1935 |
| SMARCA3 | NM_003071.2 | FPr | AGGGACTGTCCTGGCACAT | SEQ ID NO: 1936 |
| | | Probe | AGCAAAAGACCCAGGACATCTGCA | SEQ ID NO: 1937 |
| | | RPr | CAACAAATTTGCCGCAGTC | SEQ ID NO: 1938 |
| SNAI1 | NM_005985.2 | FPr | CCCAATCGGAAGCCTAACTA | SEQ ID NO: 1939 |
| | | Probe | TCTGGATTAGAGTCCTGCAGCTCGC | SEQ ID NO: 1940 |
| | | RPr | GTAGGGCTGCTGGAAGGTAA | SEQ ID NO: 1941 |
| SNAI2 | NM_003068.3 | FPr | GGCTGGCCAAACATAAGCA | SEQ ID NO: 1942 |
| | | Probe | CTGCACTGCGATGCCCAGTCTAGAAAATC | SEQ ID NO: 1943 |
| | | RPr | TCCTTGTCACAGTATTTACAGCTGAA | SEQ ID NO: 1944 |
| SNRPF | NM_003095.1 | FPr | GGCTGGTCGGCAGAGAGTAG | SEQ ID NO: 1945 |
| | | Probe | AAACTCATGTAAACCACGGCCGAATGTTG | SEQ ID NO: 1946 |
| | | RPr | TGAGGAAAGGTTTGGGATTGA | SEQ ID NO: 1947 |
| SOD1 | NM_000454.3 | FPr | TGAAGAGAGGCATGTTGGAG | SEQ ID NO: 1948 |
| | | Probe | TTTGTCAGCAGTCACATTGCCCAA | SEQ ID NO: 1949 |
| | | RPr | AATAGACACATCGGCCACAC | SEQ ID NO: 1950 |
| SOD2 | NM_000636.1 | FPr | GCTTGTCCAAATCAGGATCCA | SEQ ID NO: 1951 |
| | | Probe | AACAACAGGCCTTATTCCACTGCTGGG | SEQ ID NO: 1952 |
| | | RPr | AGCGTGCTCCCACACATCA | SEQ ID NO: 1953 |
| SOS1 | NM_005633.2 | FPr | TCTGCACCAAATTCTCCAAG | SEQ ID NO: 1954 |
| | | Probe | AACACCGTTAACACCTCCGCCTG | SEQ ID NO: 1955 |
| | | RPr | GTGGTACTGGAAGCACCAGA | SEQ ID NO: 1956 |
| SOX17 | NM_022454.2 | FPr | TCGTGTGCAAGCCTGAGA | SEQ ID NO: 1957 |
| | | Probe | CTCCCCTACCAGGGGCATGACTC | SEQ ID NO: 1958 |
| | | RPr | CTGTCGGGGAGATTCACAC | SEQ ID NO: 1959 |
| SPARC | NM_003118.1 | FPr | TCTTCCCTGTACACTGGCAGTTC | SEQ ID NO: 1960 |
| | | Probe | TGGACCAGCACCCCATTGACGG | SEQ ID NO: 1961 |
| | | RPr | AGCTCGGTGTGGGAGAGGTA | SEQ ID NO: 1962 |
| SPINT2 | NM_021102.1 | FPr | AGGAATGCAGCGGATTCCT | SEQ ID NO: 1963 |
| | | Probe | CCCAAGTGCTCCCAGAAGGCAGG | SEQ ID NO: 1964 |
| | | RPr | TCGCTGGAGTGGTCTTCAGA | SEQ ID NO: 1965 |
| SPRY1 | AK026960.1 | FPr | CAGACCAGTCCCTGGTCATAGG | SEQ ID NO: 1966 |
| | | Probe | CTGGGTCCGGATTGCCCTTTCAG | SEQ ID NO: 1967 |
| | | RPr | CCTTCAAGTCATCCACAATCAGTT | SEQ ID NO: 1968 |
| SPRY2 | NM_005842.1 | FPr | TGTGGCAAGTGCAAATGTAA | SEQ ID NO: 1969 |
| | | Probe | CAGAGGCCTTGGGTAGGTGCACTC | SEQ ID NO: 1970 |
| | | RPr | GTCGCAGATCCAGTCTGATG | SEQ ID NO: 1971 |
| SR-A1 | NM_021228.1 | FPr | AGATGGAAGAAGCCAACCTG | SEQ ID NO: 1972 |
| | | Probe | CTGGATCAGCTCCTGGGCCTTC | SEQ ID NO: 1973 |
| | | RPr | CTGTGGCTGAGGATCTGGT | SEQ ID NO: 1974 |
| ST14 | NM_021978.2 | FPr | TGACTGCACATGGAACATTG | SEQ ID NO: 1975 |
| | | Probe | AGGTGCCCAACAACCAGCATGT | SEQ ID NO: 1976 |
| | | RPr | AAGAATTTGAAGCGCACCTT | SEQ ID NO: 1977 |
| STAT1 | NM_007315.1 | FPr | GGGCTCAGCTTTCAGAAGTG | SEQ ID NO: 1978 |
| | | Probe | TGGCAGTTTTCTTCTGTCACCAAAA | SEQ ID NO: 1979 |
| | | RPr | ACATGTTCAGCTGGTCCACA | SEQ ID NO: 1980 |
| STAT3 | NM_003150.1 | FPr | TCACATGCCACTTTGGTGTT | SEQ ID NO: 1981 |
| | | Probe | TCCTGGGAGAGATTGACCAGCA | SEQ ID NO: 1982 |
| | | RPr | CTTGCAGGAAGCGGCTATAC | SEQ ID NO: 1983 |
| STAT5A | NM_003152.1 | FPr | GAGGCGCTCAACATGAAATTC | SEQ ID NO: 1984 |
| | | Probe | CGGTTGCTCTGCACTTCGGCCT | SEQ ID NO: 1985 |
| | | RPr | GCCAGGAACACGAGGTTCTC | SEQ ID NO: 1986 |
| STAT5B | NM_012448.1 | FPr | CCAGTGGTGGTGATCGTTCA | SEQ ID NO: 1987 |
| | | Probe | CAGCCAGGACAACAGTCGACGG | SEQ ID NO: 1988 |
| | | RPr | GCAAAAGCATTGTCCCAGAGA | SEQ ID NO: 1989 |
| STC1 | NM_003155.1 | FPr | CTCCGAGGTGAGGAGGACT | SEQ ID NO: 1990 |
| | | Probe | CACATCAAACGCACATCCCATGAG | SEQ ID NO: 1991 |
| | | RPr | ACCTCTCCCTGGTTATGCAC | SEQ ID NO: 1992 |

TABLE A-continued

| Gene | Accession | Reagt | Sequence | SEQ ID NO |
|---|---|---|---|---|
| STK11 | NM_000455.3 | FPr | GGACTCGGAGACGCTGTG | SEQ ID NO: 1993 |
| | | Probe | TTCTTGAGGATCTTGACGGCCCTC | SEQ ID NO: 1994 |
| | | RPr | GGGATCCTTCGCAACTTCTT | SEQ ID NO: 1995 |
| STK15 | NM_003600.1 | FPr | CATCTTCCAGGAGGACCACT | SEQ ID NO: 1996 |
| | | Probe | CTCTGTGGCACCCTGGACTACCTG | SEQ ID NO: 1997 |
| | | RPr | TCCGACCTTCAATCATTTCA | SEQ ID NO: 1998 |
| STMN1 | NM_005563.2 | FPr | AATACCCAACGCACAAATGA | SEQ ID NO: 1999 |
| | | Probe | CACGTTCTCTGCCCCGTTTCTTG | SEQ ID NO: 2000 |
| | | RPr | GGAGACAATGCAAACCACAC | SEQ ID NO: 2001 |
| STMY3 | NM_005940.2 | FPr | CCTGGAGGCTGCAACATACC | SEQ ID NO: 2002 |
| | | Probe | ATCCTCCTGAAGCCCTTTTCGCAGC | SEQ ID NO: 2003 |
| | | RPr | TACAATGGCTTTGGAGGATAGCA | SEQ ID NO: 2004 |
| STS | NM_000351.2 | FPr | GAAGATCCCTTTCCTCCTACTGTTC | SEQ ID NO: 2005 |
| | | Probe | CTTCGTGGCTCTCGGCTTCCA | SEQ ID NO: 2006 |
| | | RPr | GGATGATGTTCGGCCTTGAT | SEQ ID NO: 2007 |
| SURV | NM_001168.1 | FPr | TGTTTTGATTCCCGGGCTTA | SEQ ID NO: 2008 |
| | | Probe | TGCCTTCTTCCTCCCTCACTTCTCACCT | SEQ ID NO: 2009 |
| | | RPr | CAAAGCTGTCAGCTCTAGCAAAAG | SEQ ID NO: 2010 |
| TAGLN | NM_003186.2 | FPr | GATGGAGCAGGTGGCTCAGT | SEQ ID NO: 2011 |
| | | Probe | CCCAGAGTCCTCAGCCGCCTTCAG | SEQ ID NO: 2012 |
| | | RPr | AGTCTGGAACATGTCAGTCTTGATG | SEQ ID NO: 2013 |
| TBP | NM_003194.1 | FPr | GCCCGAAACGCCGAATATA | SEQ ID NO: 2014 |
| | | Probe | TACCGCAGCAAACCGCTTGGG | SEQ ID NO: 2015 |
| | | RPr | CGTGGCTCTCTTATCCTCATGAT | SEQ ID NO: 2016 |
| TCF-1 | NM_000545.3 | FPr | GAGGTCCTGAGCACTGCC | SEQ ID NO: 2017 |
| | | Probe | CTGGGTTCACAGGTCCTTTGTCC | SEQ ID NO: 2018 |
| | | RPr | GATGTGGGACCATGCTTGT | SEQ ID NO: 2019 |
| TCF-7 | NM_003202.2 | FPr | GCAGCTGCAGTCAACAGTTC | SEQ ID NO: 2020 |
| | | Probe | AAGTCATGGCCCAAATCCAGTGTG | SEQ ID NO: 2021 |
| | | RPr | CTGTGAATGGGAGGGGT | SEQ ID NO: 2022 |
| TCF7L1 | NM_031283.1 | FPr | CCGGGACACTTTCCAGAAG | SEQ ID NO: 2023 |
| | | Probe | TCTCACTTCGGCGAAATAGTCCCG | SEQ ID NO: 2024 |
| | | RPr | AGAACGCGCTGTCCTGAG | SEQ ID NO: 2025 |
| TCF7L2 | NM_030756.1 | FPr | CCAATCACGACAGGAGGATT | SEQ ID NO: 2026 |
| | | Probe | AGACACCCTACCCCACAGCTCTG | SEQ ID NO: 2027 |
| | | RPr | TGGACACGGAAGCATTGAC | SEQ ID NO: 2028 |
| TCFL4 | NM_170607.2 | FPr | CTGACTGCTCTGCTTAAAGGTGAA | SEQ ID NO: 2029 |
| | | Probe | TAGCAGGAACAACAACAAAAGCCAACCAA | SEQ ID NO: 2030 |
| | | RPr | ATGTCTTGCACTGGCTACCTTGT | SEQ ID NO: 2031 |
| TEK | NM_000459.1 | FPr | ACTTCGGTGCTACTTAACAACTTACATC | SEQ ID NO: 2032 |
| | | Probe | AGCTCGGACCACGTACTGCTCCCTG | SEQ ID NO: 2033 |
| | | RPr | CCTGGGCCTTGGTGTTGAC | SEQ ID NO: 2034 |
| TERC | U86046.1 | FPr | AAGAGGAACGGAGCGAGTC | SEQ ID NO: 2035 |
| | | Probe | CACGTCCCACAGCTCAGGGAATC | SEQ ID NO: 2036 |
| | | RPr | ATGTGTGAGCCGAGTCCTG | SEQ ID NO: 2037 |
| TERT | NM_003219.1 | FPr | GACATGGAGAACAAGCTGTTTGC | SEQ ID NO: 2038 |
| | | Probe | ACCAAACGCAGGAGCAGCCCG | SEQ ID NO: 2039 |
| | | RPr | GAGGTGTCACCAACAAGAAATCAT | SEQ ID NO: 2040 |
| TFF3 | NM_003226.1 | FPr | AGGCACTGTTCATCTCAGTTTTTCT | SEQ ID NO: 2041 |
| | | Probe | CAGAAAGCTTGCCGGGAGCAAAGG | SEQ ID NO: 2042 |
| | | RPr | CATCAGGCTCCAGATATGAACTTTC | SEQ ID NO: 2043 |
| TGFA | NM_003236.1 | FPr | GGTGTGCCACAGACCTTCCT | SEQ ID NO: 2044 |
| | | Probe | TTGGCCTGTAATCACCTGTGCAGCTT | SEQ ID NO: 2045 |
| | | RPr | ACGGAGTTCTTGACAGAGTTTTGA | SEQ ID NO: 2046 |
| TGFB2 | NM_003238.1 | FPr | ACCAGTCCCCCAGAAGACTA | SEQ ID NO: 2047 |
| | | Probe | TCCTGAGCCCGAGGAAGTCCC | SEQ ID NO: 2048 |
| | | RPr | CCTGGTGCTGTTGTAGATGG | SEQ ID NO: 2049 |

TABLE A-continued

| Gene | Accession | Reagt | Sequence | SEQ ID NO |
|---|---|---|---|---|
| TGFB3 | NM_003239.1 | FPr | GGATCGAGCTCTTCCAGATCCT | SEQ ID NO: 2050 |
| | | Probe | CGGCCAGATGAGCACATTGCC | SEQ ID NO: 2051 |
| | | RPr | GCCACCGATATAGCGCTGTT | SEQ ID NO: 2052 |
| TGFBI | NM_000358.1 | FPr | GCTACGAGTGCTGTCCTGG | SEQ ID NO: 2053 |
| | | Probe | CCTTCTCCCCAGGGACCTTTTCAT | SEQ ID NO: 2054 |
| | | RPr | AGTGGTAGGGCTGCTGGAC | SEQ ID NO: 2055 |
| TGFBR1 | NM_004612.1 | FPr | GTCATCACCTGGCCTTGG | SEQ ID NO: 2056 |
| | | Probe | AGCAATGACAGCTGCCAGTTCCAC | SEQ ID NO: 2057 |
| | | RPr | GCAGACGAAGCACACTGGT | SEQ ID NO: 2058 |
| TGFBR2 | NM_003242.2 | FPr | AACACCAATGGGTTCCATCT | SEQ ID NO: 2059 |
| | | Probe | TTCTGGGCTCCTGATTGCTCAAGC | SEQ ID NO: 2060 |
| | | RPr | CCTCTTCATCAGGCCAAACT | SEQ ID NO: 2061 |
| THBS1 | NM_003246.1 | FPr | CATCCGCAAAGTGACTGAAGAG | SEQ ID NO: 2062 |
| | | Probe | CCAATGAGCTGAGGCGGCCTCC | SEQ ID NO: 2063 |
| | | RPr | GTACTGAACTCCGTTGTGATAGCATAG | SEQ ID NO: 2064 |
| THY1 | NM_006288.2 | FPr | GGACAAGACCCTCTCAGGCT | SEQ ID NO: 2065 |
| | | Probe | CAAGCTCCCAAGAGCTTCCAGAGC | SEQ ID NO: 2066 |
| | | RPr | TTGGAGGCTGTGGGTCAG | SEQ ID NO: 2067 |
| TIMP1 | NM_003254.1 | FPr | TCCCTGCGGTCCCAGATAG | SEQ ID NO: 2068 |
| | | Probe | ATCCTGCCCGGAGTGGAACTGAAGC | SEQ ID NO: 2069 |
| | | RPr | GTGGGAACAGGGTGGACACT | SEQ ID NO: 2070 |
| TIMP2 | NM_003255.2 | FPr | TCACCCTCTGTGACTTCATCGT | SEQ ID NO: 2071 |
| | | Probe | CCCTGGGACACCCTGAGCACCA | SEQ ID NO: 2072 |
| | | RPr | TGTGGTTCAGGCTCTTCTTCTG | SEQ ID NO: 2073 |
| TIMP3 | NM_000362.2 | FPr | CTACCTGCCTTGCTTTGTGA | SEQ ID NO: 2074 |
| | | Probe | CCAAGAACGAGTGTCTCTGGACCG | SEQ ID NO: 2075 |
| | | RPr | ACCGAAATTGGAGAGCATGT | SEQ ID NO: 2076 |
| TJP1 | NM_003257.1 | FPr | ACTTTGCTGGGACAAAGGTC | SEQ ID NO: 2077 |
| | | Probe | CTCGGGCCTGCCCACTTCTTC | SEQ ID NO: 2078 |
| | | RPr | CACATGGACTCCTCAGCATC | SEQ ID NO: 2079 |
| TK1 | NM_003258.1 | FPr | GCCGGGAAGACCGTAATTGT | SEQ ID NO: 2080 |
| | | Probe | CAAATGGCTTCCTCTGGAAGGTCCCA | SEQ ID NO: 2081 |
| | | RPr | CAGCGGCACCAGGTTCAG | SEQ ID NO: 2082 |
| TLN1 | NM_006289.2 | FPr | AAGCAGAAGGGAGAGCGTAAGA | SEQ ID NO: 2083 |
| | | Probe | CTTCCAGGCACACAAGAATTGTGGGC | SEQ ID NO: 2084 |
| | | RPr | CCTTGGCCTCAATCTCACTCA | SEQ ID NO: 2085 |
| TMEPAI | NM_020182.3 | FPr | CAGAAGGATGCCTGTGGC | SEQ ID NO: 2086 |
| | | Probe | ATTCCGTTGCCTGACACTGTGCTC | SEQ ID NO: 2087 |
| | | RPr | GTAGACCTGCGGCTCTGG | SEQ ID NO: 2088 |
| TMSB10 | NM_021103.2 | FPr | GAAATCGCCAGCTTCGATAA | SEQ ID NO: 2089 |
| | | Probe | CGTCTCCGTTTTCTTCAGCTTGGC | SEQ ID NO: 2090 |
| | | RPr | GTCGGCAGGGTGTTCTTTT | SEQ ID NO: 2091 |
| TMSB4X | NM_021109.2 | FPr | CACATCAAAGAACTACTGACAACGAA | SEQ ID NO: 2092 |
| | | Probe | CCGCGCCTGCCTTTCCCA | SEQ ID NO: 2093 |
| | | RPr | CCTGCCAGCCAGATAGATAGACA | SEQ ID NO: 2094 |
| TNC | NM_002160.1 | FPr | AGCTCGGAACCTCACCGT | SEQ ID NO: 2095 |
| | | Probe | CAGCCTTCGGGCTGTGGACATAC | SEQ ID NO: 2096 |
| | | RPr | GTAGCAGCCTTGAGGCCC | SEQ ID NO: 2097 |
| TNF | NM_000594.1 | FPr | GGAGAAGGGTGACCGACTCA | SEQ ID NO: 2098 |
| | | Probe | CGCTGAGATCAATCGGCCCGACTA | SEQ ID NO: 2099 |
| | | RPr | TGCCCAGACTCGGCAAAG | SEQ ID NO: 2100 |
| TNFRSF5 | NM_001250.3 | FPr | TCTCACCTCGCTATGGTTCGT | SEQ ID NO: 2101 |
| | | Probe | TGCCTCTGCAGTGCGTCCTCTGG | SEQ ID NO: 2102 |
| | | RPr | GATGGACAGCGGTCAGCAA | SEQ ID NO: 2103 |
| TNFRSF6B | NM_003823.2 | FPr | CCTCAGCACCAGGGTACCA | SEQ ID NO: 2104 |
| | | Probe | TGACGGCACGCTCACACTCCTCAG | SEQ ID NO: 2105 |
| | | RPr | TGTCCTGGAAAGCCACAAAGT | SEQ ID NO: 2106 |
| TNFSF4 | NM_003326.2 | FPr | CTTCATCTTCCCTCTACCCAGA | SEQ ID NO: 2107 |
| | | Probe | CAGGGGTTGGACCCTTTCCATCTT | SEQ ID NO: 2108 |

TABLE A-continued

| Gene | Accession | Reagt | Sequence | SEQ ID NO |
|---|---|---|---|---|
| | | RPr | GCTGCATTTCCCACATTCTC | SEQ ID NO: 2109 |
| TOP2A | NM_001067.1 | FPr | AATCCAAGGGGAGAGTGAT | SEQ ID NO: 2110 |
| | | Probe | CATATGGACTTTGACTCAGCTGTGGC | SEQ ID NO: 2111 |
| | | RPr | GTACAGATTTTGCCCGAGGA | SEQ ID NO: 2112 |
| TOP2B | NM_001068.1 | FPr | TGTGGACATCTTCCCCTCAGA | SEQ ID NO: 2113 |
| | | Probe | TTCCCTACTGAGCCACCTTCTCTG | SEQ ID NO: 2114 |
| | | RPr | CTAGCCCGACCGGTTCGT | SEQ ID NO: 2115 |
| TP | NM_001953.2 | FPr | CTATATGCAGCCAGAGATGTGACA | SEQ ID NO: 2116 |
| | | Probe | ACAGCCTGCCACTCATCACAGCC | SEQ ID NO: 2117 |
| | | RPr | CCACGAGTTTCTTACTGAGAATGG | SEQ ID NO: 2118 |
| TP53BP1 | NM_005657.1 | FPr | TGCTGTTGCTGAGTCTGTTG | SEQ ID NO: 2119 |
| | | Probe | CCAGTCCCCAGAAGACCATGTCTG | SEQ ID NO: 2120 |
| | | RPr | CTTGCCTGGCTTCACAGATA | SEQ ID NO: 2121 |
| TP53BP2 | NM_005426.1 | FPr | GGGCCAAATATTCAGAAGC | SEQ ID NO: 2122 |
| | | Probe | CCACCATAGCGGCCATGGAG | SEQ ID NO: 2123 |
| | | RPr | GGATGGGTATGATGGGACAG | SEQ ID NO: 2124 |
| TP53I3 | NM_004881.2 | FPr | GCGGACTTAATGCAGAGACA | SEQ ID NO: 2125 |
| | | Probe | CAGTATGACCCACCTCCAGGAGCC | SEQ ID NO: 2126 |
| | | RPr | TCAAGTCCCAAAATGTTGCT | SEQ ID NO: 2127 |
| TRAG3 | NM_004909.1 | FPr | GACGCTGGTCTGGTGAAGATG | SEQ ID NO: 2128 |
| | | Probe | CCAGGAAACCACGAGCCTCCAGC | SEQ ID NO: 2129 |
| | | RPr | TGGGTGGTTGTTGGACAATG | SEQ ID NO: 2130 |
| TRAIL | NM_003810.1 | FPr | CTTCACAGTGCTCCTGCAGTCT | SEQ ID NO: 2131 |
| | | Probe | AAGTACACGTAAGTTACAGCCACACA | SEQ ID NO: 2132 |
| | | RPr | CATCTGCTTCAGCTCGTTGGT | SEQ ID NO: 2133 |
| TS | NM_001071.1 | FPr | GCCTCGGTGTGCCTTTCA | SEQ ID NO: 2134 |
| | | Probe | CATCGCCAGCTACGCCCTGCTC | SEQ ID NO: 2135 |
| | | RPr | CGTGATGTGCGCAATCATG | SEQ ID NO: 2136 |
| TST | NM_003312.4 | FPr | GGAGCCGGATGCAGTAGGA | SEQ ID NO: 2137 |
| | | Probe | ACCACGGATATGGCCCGAGTCCA | SEQ ID NO: 2138 |
| | | RPr | AAGTCCATGAAAGGCATGTTGA | SEQ ID NO: 2139 |
| TUBA1 | NM_006000.1 | FPr | TGTCACCCCGACTCAACGT | SEQ ID NO: 2140 |
| | | Probe | AGACGCACCGCCCGGACTCAC | SEQ ID NO: 2141 |
| | | RPr | ACGTGGACTGAGATGCATTCAC | SEQ ID NO: 2142 |
| TUBB | NM_001069.1 | FPr | CGAGGACGAGGCTTAAAAAC | SEQ ID NO: 2143 |
| | | Probe | TCTCAGATCAATCGTGCATCCTTAGTGAA | SEQ ID NO: 2144 |
| | | RPr | ACCATGCTTGAGGACAACAG | SEQ ID NO: 2145 |
| TUFM | NM_003321.3 | FPr | GTATCACCATCAATGCGGC | SEQ ID NO: 2146 |
| | | Probe | CATGTGGAGTATAGCACTGCCGCC | SEQ ID NO: 2147 |
| | | RPr | CAGTCTGTGTGGGCGTAGTG | SEQ ID NO: 2148 |
| TULP3 | NM_003324.2 | FPr | TGTGTATAGTCCTGCCCCTCAA | SEQ ID NO: 2149 |
| | | Probe | CCGGATTATCCGACATCTTACTGTGA | SEQ ID NO: 2150 |
| | | RPr | CCCGATCCATTCCCCTTTTA | SEQ ID NO: 2151 |
| tusc4 | NM_006545.4 | FPr | GGAGGAGCTAAATGCCTCAG | SEQ ID NO: 2152 |
| | | Probe | ACTCATCAATGGGCAGAGTGCACC | SEQ ID NO: 2153 |
| | | RPr | CCTTCAAGTGGATGGTGTTG | SEQ ID NO: 2154 |
| UBB | NM_018955.1 | FPr | GAGTCGACCCTGCACCTG | SEQ ID NO: 2155 |
| | | Probe | AATTAACAGCCACCCCTCAGGCG | SEQ ID NO: 2156 |
| | | RPr | GCGAATGCCATGACTGAA | SEQ ID NO: 2157 |
| UBC | NM_021009.2 | FPr | ACGCACCCTGTCTGACTACA | SEQ ID NO: 2158 |
| | | Probe | CATCCAGAAAGAGTCCACCCTGCA | SEQ ID NO: 2159 |
| | | RPr | ACCTCTAAGACGGAGCACCA | SEQ ID NO: 2160 |
| UBE2C | NM_007019.2 | FPr | TGTCTGGCGATAAAGGGATT | SEQ ID NO: 2161 |
| | | Probe | TCTGCCTTCCCTGAATCAGACAACC | SEQ ID NO: 2162 |
| | | RPr | ATGGTCCCTACCCATTTGAA | SEQ ID NO: 2163 |
| UBE2M | NM_003969.1 | FPr | CTCCATAATTTATGGCCTGCAGTA | SEQ ID NO: 2164 |
| | | Probe | TCTTCTTGGAGCCCAACCCCGAG | SEQ ID NO: 2165 |
| | | RPr | TGCGGCCTCCTTGTTCAG | SEQ ID NO: 2166 |

TABLE A-continued

| Gene | Accession | Reagt | Sequence | SEQ ID NO |
|---|---|---|---|---|
| UBL1 | NM_003352.3 | FPr | GTGAAGCCACCGTCATCATG | SEQ ID NO: 2167 |
| | | Probe | CTGACCAGGAGGCAAAACCTTCAACTGA | SEQ ID NO: 2168 |
| | | RPr | CCTTCCTTCTTATCCCCCAAGT | SEQ ID NO: 2169 |
| UCP2 | NM_003355.2 | FPr | ACCATGCTCCAGAAGGAGG | SEQ ID NO: 2170 |
| | | Probe | CCCCGAGCCTTCTACAAAGGGTTC | SEQ ID NO: 2171 |
| | | RPr | AACCCAAGCGGAGAAAGG | SEQ ID NO: 2172 |
| UGT1A1 | NM_000463.2 | FPr | CCATGCAGCCTGGAATTTG | SEQ ID NO: 2173 |
| | | Probe | CTACCCAGTGCCCCAACCCATTCTC | SEQ ID NO: 2174 |
| | | RPr | GAGAGGCCTGGGCACGTA | SEQ ID NO: 2175 |
| UMPS | NM_000373.1 | FPr | TGCGGAAATGAGCTCCAC | SEQ ID NO: 2176 |
| | | Probe | CCCTGGCCACTGGGGACTACACTA | SEQ ID NO: 2177 |
| | | RPr | CCTCAGCCATTCTAACCGC | SEQ ID NO: 2178 |
| UNC5A | XM_030300.7 | FPr | GACAGCTGATCCAGGAGCC | SEQ ID NO: 2179 |
| | | Probe | CGGGTCCTGCACTTCAAGGACAGT | SEQ ID NO: 2180 |
| | | RPr | ATGGATAGGCGCAGGTTG | SEQ ID NO: 2181 |
| UNC5B | NM_170744.2 | FPr | AGAACGGAGGCCGTGACT | SEQ ID NO: 2182 |
| | | Probe | CGGGACGCTGCTCGACTCTAAGAA | SEQ ID NO: 2183 |
| | | RPr | CATGCACAGCCCATCTGT | SEQ ID NO: 2184 |
| UNC5C | NM_003728.2 | FPr | CTGAACACAGTGGAGCTGGT | SEQ ID NO: 2185 |
| | | Probe | ACCTGCCGCACACAGAGTTTGC | SEQ ID NO: 2186 |
| | | RPr | CTGGAAGATCTGCCCTTCTC | SEQ ID NO: 2187 |
| upa | NM_002658.1 | FPr | GTGGATGTGCCCTGAAGGA | SEQ ID NO: 2188 |
| | | Probe | AAGCCAGGCGTCTACACGAGAGTCTCAC | SEQ ID NO: 2189 |
| | | RPr | CTGCGGATCCAGGGTAAGAA | SEQ ID NO: 2190 |
| UPP1 | NM_003364.2 | FPr | ACGGGTCCTGCCTCAGTT | SEQ ID NO: 2191 |
| | | Probe | TCAGCTTTCTCTGCATTGGCTCCC | SEQ ID NO: 2192 |
| | | RPr | CGGGGCAATCATTGTGAC | SEQ ID NO: 2193 |
| VCAM1 | NM_001078.2 | FPr | TGGCTTCAGGAGCTGAATACC | SEQ ID NO: 2194 |
| | | Probe | CAGGCACACACAGGTGGGACACAAAT | SEQ ID NO: 2195 |
| | | RPr | TGCTGTCGTGATGAGAAAATAGTG | SEQ ID NO: 2196 |
| VCL | NM_003373.2 | FPr | GATACCACAACTCCCATCAAGCT | SEQ ID NO: 2197 |
| | | Probe | AGTGGCAGCCACGGCGCC | SEQ ID NO: 2198 |
| | | RPr | TCCCTGTTAGGCGCATCAG | SEQ ID NO: 2199 |
| VCP | NM_007126.2 | FPr | GGCTTTGGCAGCTTCAGAT | SEQ ID NO: 2200 |
| | | Probe | AGCTCCACCCTGGTTCCCTGAAG | SEQ ID NO: 2201 |
| | | RPr | CTCCACTGCCCTGACTGG | SEQ ID NO: 2202 |
| VDAC1 | NM_003374.1 | FPr | GCTGCGACATGGATTTCGA | SEQ ID NO: 2203 |
| | | Probe | TTGCTGGGCCTTCCATCCGG | SEQ ID NO: 2204 |
| | | RPr | CCAGCCCTCGTAACCTAGCA | SEQ ID NO: 2205 |
| VDAC2 | NM_003375.2 | FPr | ACCCACGGACAGACTTGC | SEQ ID NO: 2206 |
| | | Probe | CGCGTCCAATGTGTATTCCTCCAT | SEQ ID NO: 2207 |
| | | RPr | AGCTTTGCCAAGGTCAGC | SEQ ID NO: 2208 |
| VDR | NM_000376.1 | FPr | GCCCTGGATTTCAGAAAGAG | SEQ ID NO: 2209 |
| | | Probe | CAAGTCTGGATCTGGGACCCTTTCC | SEQ ID NO: 2210 |
| | | RPr | AGTTACAAGCCAGGGAAGGA | SEQ ID NO: 2211 |
| VEGF | NM_003376.3 | FPr | CTGCTGTCTTGGGTGCATTG | SEQ ID NO: 2212 |
| | | Probe | TTGCCTTGCTGCTCTACCTCCACCA | SEQ ID NO: 2213 |
| | | RPr | GCAGCCTGGGACCACTTG | SEQ ID NO: 2214 |
| VEGF_altsplice1 | AF486837.1 | FPr | TGTGAATGCAGACCAAAGAAAGA | SEQ ID NO: 2215 |
| | | Probe | AGAGCAAGACAAGAAAATCCCTGTGGGC | SEQ ID NO: 2216 |
| | | RPr | GCTTTCTCCGCTCTGAGCAA | SEQ ID NO: 2217 |
| VEGF_altsplice2 | AF214570.1 | FPr | AGCTTCCTACAGCACAACAAAT | SEQ ID NO: 2218 |
| | | Probe | TGTCTTGCTCTATCTTTCTTTGGTCTGCA | SEQ ID NO: 2219 |
| | | RPr | CTCGGCTTGTCACATTTTTC | SEQ ID NO: 2220 |
| VEGFB | NM_003377.2 | FPr | TGACGATGGCCTGGAGTGT | SEQ ID NO: 2221 |
| | | Probe | CTGGGCAGCACCAAGTCCGGA | SEQ ID NO: 2222 |
| | | RPr | GGTACCGGATCATGAGGATCTG | SEQ ID NO: 2223 |
| VEGFC | NM_005429.2 | FPr | CCTCAGCAAGACGTTATTTGAAATT | SEQ ID NO: 2224 |
| | | Probe | CCTCTCTCTCAAGGCCCCAAACCAGT | SEQ ID NO: 2225 |

TABLE A-continued

| Gene | Accession | Reagt | Sequence | SEQ ID NO |
|------|-----------|-------|----------|-----------|
| | | RPr | AAGTGTGATTGGCAAAACTGATTG | SEQ ID NO: 2226 |
| VIM | NM_003380.1 | FPr | TGCCCTTAAAGGAACCAATGA | SEQ ID NO: 2227 |
| | | Probe | ATTTCACGCATCTGGCGTTCCA | SEQ ID NO: 2228 |
| | | RPr | GCTTCAACGGCAAAGTTCTCTT | SEQ ID NO: 2229 |
| WIF | NM_007191.2 | FPr | TACAAGCTGAGTGCCCAGG | SEQ ID NO: 2230 |
| | | Probe | TACAAAAGCCTCCATTTCGGCACC | SEQ ID NO: 2231 |
| | | RPr | CACTCGCAGATGCGTCTTT | SEQ ID NO: 2232 |
| WISP1 | NM_003882.2 | FPr | AGAGGCATCCATGAACTTCACA | SEQ ID NO: 2233 |
| | | Probe | CGGGCTGCATCAGCACACGC | SEQ ID NO: 2234 |
| | | RPr | CAAACTCCACAGTACTTGGGTTGA | SEQ ID NO: 2235 |
| Wnt-3a | NM_033131.2 | FPr | ACAAAGCTACCAGGGAGTCG | SEQ ID NO: 2236 |
| | | Probe | TTTGTCCACGCCATTGCCTCAG | SEQ ID NO: 2237 |
| | | RPr | TGAGCGTGTCACTGCAAAG | SEQ ID NO: 2238 |
| Wnt-5a | NM_003392.2 | FPr | GTATCAGGACCACATGCAGTACATC | SEQ ID NO: 2239 |
| | | Probe | TTGATGCCTGTCTTCGCGCCTTCT | SEQ ID NO: 2240 |
| | | RPr | TGTCGGAATTGATACTGGCATT | SEQ ID NO: 2241 |
| Wnt-5b | NM_032642.2 | FPr | TGTCTTCAGGGTCTTGTCCA | SEQ ID NO: 2242 |
| | | Probe | TTCCGTAAGAGGCCTGGTGCTCTC | SEQ ID NO: 2243 |
| | | RPr | GTGCACGTGGATGAAAGAGT | SEQ ID NO: 2244 |
| WNT2 | NM_003391.1 | FPr | CGGTGGAATCTGGCTCTG | SEQ ID NO: 2245 |
| | | Probe | CTCCCTCTGCTCTTGACCTGGCTC | SEQ ID NO: 2246 |
| | | RPr | CCATGAAGAGTTGACCTCGG | SEQ ID NO: 2247 |
| WWOX | NM_016373.1 | FPr | ATCGCAGCTGGTGGGTGTA | SEQ ID NO: 2248 |
| | | Probe | CTGCTGTTTACCTTGGCGAGGCCTTT | SEQ ID NO: 2249 |
| | | RPr | AGCTCCCTGTTGCATGGACTT | SEQ ID NO: 2250 |
| XPA | NM_000380.2 | FPr | GGGTAGAGGGAAAAGGGTTC | SEQ ID NO: 2251 |
| | | Probe | CAAAGGCTGAACTGGATTCTTAACCAAGA | SEQ ID NO: 2252 |
| | | RPr | TGCACCACCATTGCTATTATT | SEQ ID NO: 2253 |
| XPC | NM_004628.2 | FPr | GATACATCGTCTGCGAGGAA | SEQ ID NO: 2254 |
| | | Probe | TTCAAAGACGTGCTCCTGACTGCC | SEQ ID NO: 2255 |
| | | RPr | CTTTCAATGACTGCCTGCTC | SEQ ID NO: 2256 |
| XRCC1 | NM_006297.1 | FPr | GGAGATGAAGCCCCCAAG | SEQ ID NO: 2257 |
| | | Probe | AGAAGCAACCCCAGACCAAAACCA | SEQ ID NO: 2258 |
| | | RPr | GTCCAGCTGCCTGAGTGG | SEQ ID NO: 2259 |
| YB-1 | NM_004559.1 | FPr | AGACTGTGGAGTTTGATGTTGTTGA | SEQ ID NO: 2260 |
| | | Probe | TTGCTGCCTCCGCACCCTTTTCT | SEQ ID NO: 2261 |
| | | RPr | GGAACACCACCAGGACCTGTAA | SEQ ID NO: 2262 |
| YWHAH | NM_003405.2 | FPr | CATGGCCTCCGCTATGAA | SEQ ID NO: 2263 |
| | | Probe | AGGTTCATTCAGCTCTGTCACCGC | SEQ ID NO: 2264 |
| | | RPr | GGAGATTTCGATCTTCATTGGA | SEQ ID NO: 2265 |
| zbtb7 | NM_015898.2 | FPr | CTGCGTTCACACCCCAGT | SEQ ID NO: 2266 |
| | | Probe | TCTCTCCAGAACAGCTCGCCCTGT | SEQ ID NO: 2267 |
| | | RPr | CTCAGCCACGACAGATGGT | SEQ ID NO: 2268 |
| ZG16 | NM_152338.1 | FPr | TGCTGAGCCTCCTCTCCTTT | SEQ ID NO: 2269 |
| | | Probe | TACTCCTCATCACAGTGCCCTGC | SEQ ID NO: 2270 |
| | | RPr | GGATGGGGGTTAGTGATAAGG | SEQ ID NO: 2271 |

TABLE B

| Gene | Locus Link | Sequence | SEQ ID NO |
|------|-----------|----------|-----------|
| A-Catenin | NM_001903.1 | CGTTCCGATCCTCTATACTGCATCCCAGGCATGCCTACA GCACCCTGATGTCGCAGCCTATAAGGCCAACAGGGACCT | SEQ ID NO: 1 |
| ABCB1 | NM_000927.2 | AAACACCACTGGAGCATTGACTACCAGGCTCGCCAATG ATGCTGCTCAAGTTAAAGGGGCTATAGGTTCCAGGCTTG | SEQ ID NO: 2 |
| ABCC5 | NM_005688.1 | TGCAGACTGTACCATGCTGACCATTGCCCATCGCCTGC ACACGGTTCTAGGCTCCGATAGGATTATGGTGCTGGCC | SEQ ID NO: 3 |

TABLE B-continued

| Gene | Locus Link | Sequence | SEQ ID NO |
|---|---|---|---|
| ABCC6 | NM_001171.2 | GGATGAACCTCGACCTGCTGCAGGAGCACTCGG ACGAGGCTATCTGGGCAGCCCTGGAGACGGTGCAGCTC | SEQ ID NO: 4 |
| ACP1 | NM_004300.2 | GCTACCAAGTCCGTGCTGTTTGTGTGTCTGGGTA ACATTTGTCGATCACCCATTGCAGAAGCAGTTTTC | SEQ ID NO: 5 |
| ADAM10 | NM_001110.1 | CCCATCAACTTGTGCCAGTACAGGGTCTGTGC AGTGGAGTAGGCACTTCAGTGGTCGAACCATCACC | SEQ ID NO: 6 |
| ADAM17 | NM_003183.3 | GAAGTGCCAGGAGGCGATTAATGCTACTTGCAAAGGC GTGTCCTACTGCACAGGTAATAGCAGTGAGTGCCCG | SEQ ID NO: 7 |
| ADAMTS12 | NM_030955.2 | GGAGAAGGGTGGAGTGCAGCACCCAGATGG ATTCTGACTGTGCGGCCATCCAGAGACCTGACCCTG | SEQ ID NO: 8 |
| ADPRT | NM_001618.2 | TTGACAACCTGCTGGACATCGAGGTGGCCTACAGTCTGC TCAGGGGAGGGTCTGATGATAGCAGCAAGGATCCCAT | SEQ ID NO: 9 |
| AGXT | NM_000030.1 | CTTTTCCCTCCAGTGGCACCTCCTGGAAACAGTCCACTTG GGCGCAAAACCCAGTGCCTTCCAAAT | SEQ ID NO: 10 |
| AKAP12 | NM_005100.2 | TAGAGAGCCCCTGACAATCCTGAGGCTTCATCAGGAG CTAGAGCCATTTAACATTTCCTCTTTCCAAGACCAACC | SEQ ID NO: 11 |
| AKT1 | NM_005163.1 | CGCTTCTATGGCGCTGAGATTGTGTCAGCCCTGGACTAC CTGCACTCGGAGAAGAACGTGGTGTACCGGGA | SEQ ID NO: 12 |
| AKT2 | NM_001626.2 | TCCTGCCACCCTTCAAACCTCAGGTCACGTCCGAGGTCG ACACAAGGTACTTCGATGATGAATTTACCGCC | SEQ ID NO: 13 |
| AKT3 | NM_005465.1 | TTGTCTGTGCCTTGGACTATCTACATTCCGGAAAGATTGT GTACCGTGATCTCAAGTTGGAGAATCTAATGCTGG | SEQ ID NO: 14 |
| AL137428 | AL137428.1 | CAAGAAGAGGCTCTACCCTGGGACTGGGAATTTCCAA GGCCACCTTTGAGGATCGCAGAGCTCATTT | SEQ ID NO: 15 |
| ALCAM | NM_001627.1 | GAGGAATATGGAATCCAAGGGGCCAGTTCCTGCC GTCTGCTCTTCTGCCTCTTGATCTCCGCCAC | SEQ ID NO: 16 |
| ALDH1A1 | NM_000689.1 | GAAGGAGATAAGGAGGATGTTGACAAGGCAGTGAAGGC CGCAAGACAGGCTTTTCAGATTGGATCTCCGTGGCG | SEQ ID NO: 17 |
| ALDOA | NM_000034.2 | GCCTGTACGTGCCAGCTCCCCGACTGCCAGAGCCTCAACT GTCTCTGCTTCGAGATCAAGCTCCGATGA | SEQ ID NO: 18 |
| AMFR | NM_001144.2 | GATGGTTCAGCTCTGCAAGGATCGATTTGAATATCTTTCCT TCTCGCCCACCACGCCGATGAGCAGCCACGGTCGA | SEQ ID NO: 19 |
| ANGPT2 | NM_001147.1 | CCGTGAAAGCTGCTCTGTAAAAGCTGACACAGCCCTCCCA AGTGAGCAGGACTGTTCTTCCCACTGCAA | SEQ ID NO: 20 |
| ANTXR1 | NM_032208.1 | CTCCAGGTGTACCTCCAACCCTAGCCTTCTCCCACAGCTG CCTACAACAGAGTCTCCCAGCCTTCTC | SEQ ID NO: 21 |
| ANXA1 | NM_000700.1 | GCCCCTATCCTACCTTCAATCCATCCTCGGATGTCGCTGCC TTGCATAAGGCCATAATGGTTAAAGG | SEQ ID NO: 22 |
| ANXA2 | NM_004039.1 | CAAGACACTAAGGGCGACTACCAGAAAGCGCTGCTGTACCT GTGTGGTGGAGATGACTGAAGCCCGACACG | SEQ ID NO: 23 |
| ANXA5 | NM_001154.2 | GCTCAAGCCTGGAAGATGACGTGGTGGGGACACTTCAGGG TACTACCAGCGGATGTTGGTGGTTCT | SEQ ID NO: 24 |
| AP-1 (JUN official) | NM_002228.2 | GACTGCAAAGATGGAAACGACCTTCTATGACGATGCCCTC AACGCCTCGTTCCTCCCGTCCGAGAGCGGACCTTATGGCTA | SEQ ID NO: 25 |
| APC | NM_000038.1 | GGACAGCAGGAATGTGTTTCTCCATACAGGTCACGGGGAGCC AATGGTTCAGAAACAAATCGAGTGGGT | SEQ ID NO: 26 |
| APEX-1 | NM_001641.2 | GATGAAGCCTTTCGCAAGTTCCTGAAGGGCCTGGCTTCCC GAAAGCCCCTTGTGCTGTGTGGAGACCT | SEQ ID NO: 27 |
| APG-1 | NM_014278.2 | ACCCCGGCCTGTATATCATTGGGATCAAGAACTCGAGCCAT TGGAAATGCAGCAAAGAGCCAGATAG | SEQ ID NO: 28 |
| APN (ANPEP official) | NM_001150.1 | CCACCTTGGACCAAAGTAAAGCGTGGAATCGTTACCGCCTCCC CAACACGCTGAAACCCGATTCCTACCAGGTGACGCTGAGA | SEQ ID NO: 29 |

TABLE B-continued

| Gene | Locus Link | Sequence | SEQ ID NO |
|---|---|---|---|
| APOC1 | NM_001645.3 | GGAAACACACTGGAGGACAAGGCTCGGGAACTCATCAGCCGC ATCAAACAGAGTGAACTTTCTGCCAAGATGCG | SEQ ID NO: 30 |
| AREG | NM_001657.1 | TGTGAGTGAAATGCCTTCTAGTAGTGAACCGTCCTCGGGAGCC GACTATGACTACTCAGAAGAGTATGATAACGAACCACAA | SEQ ID NO: 31 |
| ARG | NM_005158.2 | CGCAGTGCAGCTGAGTATCTGCTCAGCAGTCTAATCAATGGCAG CTTCCTGGTGCGAGAAAGTGAGAGTAGCCCTGGGCA | SEQ ID NO: 32 |
| ARHF | NM_019034.2 | ACTGGCCCACTTAGTCCTCAAGCTCCCAACCTGCTGTCCCTCA AGCCCCGCTTCTACCAGCCTGTGGAGTTCAG | SEQ ID NO: 33 |
| ATOH1 | NM_005172.1 | GCAGCCACCTGCAACTTTGCAGGCGAGAGAGCATCCCGTCTA CCCGCCTGAGCTGTCCCTCCTGGA | SEQ ID NO: 34 |
| ATP5A1 | NM_004046.3 | GATGCTGCCACTCAACAACTTTTGAGTCGTGGCGTGCGTCT AACTGAGTTGCTGAAGCAAGGACA | SEQ ID NO: 35 |
| ATP5E | NM_006886.2 | CCGCTTTCGCTACAGCATGGTGGCCTACTGGAGACAGGCTGG ACTCAGCTACATCCGATACTCCCA | SEQ ID NO: 36 |
| AURKB | NM_004217.1 | AGCTGCAGAAGAGCTGCACATTTGACGAGCAGCGAACAGCCAC GATCATGGAGGAGTTGGCAGATGC | SEQ ID NO: 37 |
| Axin 2 | NM_004655.2 | GGCTATGTCTTTGCACCAGCCACCAGCGCCAACGACAGTGAGA TATCCAGTGATGCGCTGACGGAT | SEQ ID NO: 38 |
| axin1 | NM_003502.2 | CCGTGTGACAGCATCGTTGTGGCGTACTACTTCTGCGGGGAACC CATCCCCTACCGCACCCTGGTGAG | SEQ ID NO: 39 |
| B-Catenin | NM_001904.1 | GGCTCTTGTGCGTACTGTCCTTCGGGCTGGTGACAGGGAA GACATCACTGAGCCTGCCATCTGTGCTCTTCGTCATCTGA | SEQ ID NO: 40 |
| BAD | NM_032989.1 | GGGTCAGGTGCCTCGAGATCGGGCTTGGGCCCAGAGCAT GTTCCAGATCCCAGAGTTTGAGCCGAGTGAGGAG | SEQ ID NO: 41 |
| BAG1 | NM_004323.2 | CGTTGTCAGCACTTGGAATACAAGATGGTTGCCGGGTCATG TTAATTGGGAAAAAGAACAGTCCACAGGAAGAGGTTGAAC | SEQ ID NO: 42 |
| BAG2 | NM_004282.2 | CTAGGGGCAAAAAGCATGACTGCTTTTTCCTGTCTGGCATGG AATCACGCAGTCACCTTGGGCATTTAG | SEQ ID NO: 43 |
| BAG3 | NM_004281.2 | GAAAGTAAGCCAGGCCCAGTTGGACCAGAACTCCCTCCT GGACACATCCCAATTCAAGTGATCCGCAAAGAGGT | SEQ ID NO: 44 |
| Bak | NM_001188.1 | CCATTCCCACCATTCTACCTGAGGCCAGGACGTCTGGGG TGTGGGGATTGGTGGGTCTATGTTCCC | SEQ ID NO: 45 |
| Bax | NM_004324.1 | CCGCCGTGGACACAGACTCCCCCCGAGAGGTCTTTTTCCGA GTGGCAGCTGACATGTTTTCTGACGGCAA | SEQ ID NO: 46 |
| BBC3 | NM_014417.1 | CCTGGAGGGTCCTGTACAATCTCATCATGGGACTCCTGCCCTTA CCCAGGGGCCACAGAGCCCCGAGATGGAGCCCAATTAG | SEQ ID NO: 47 |
| BCAS1 | NM_003657.1 | CCCCGAGACAACGGAGATAAGTGCTGTTGCGGATGCCAACGGA AAGAATCTTGGGAAAGAGGCCAAACCCGAG | SEQ ID NO: 48 |
| Bcl2 | NM_000633.1 | CAGATGGACCTAGTACCCACTGAGATTTCCACGCCGAAGGACAG CGATGGGAAAAATGCCCTTAAATCATAGG | SEQ ID NO: 49 |
| BCL2L10 | NM_020396.2 | GCTGGGATGGCTTTTGTCACTTCTTCAGGACCCCCTTTCCA CTGGCTTTTTGGAGAAAACAGCTGGTCCAGGC | SEQ ID NO: 50 |
| BCL2L11 | NM_138621.1 | AATTACCAAGCAGCCGAAGACCACCCACGAATGGTTATCTT ACGACTGTTACGTTACATTGTCCGCCTG | SEQ ID NO: 51 |
| BCL2L12 | NM_138639.1 | AACCCACCCCTGTCTTGGAGCTCCGGGTAGCTCTCAAACTC GAGGCTGCGCACCCCCTTTCCCGTCAGCTGAG | SEQ ID NO: 52 |
| Bclx | NM_001191.1 | CTTTTGTGGAACTCTATGGGAACAATGCAGCAGCCGAGAGCCGA AAGGGCCAGGAACGCTTCAACCGCTG | SEQ ID NO: 53 |
| BCRP | NM_004827.1 | TGTACTGGCGAAGAATATTTGGTAAAGCAGGGCATCGATCTCT CACCCTGGGGCTTGTGGAAGAATCACGTGGC | SEQ ID NO: 54 |
| BFGF | NM_007083.1 | CCAGGAAGAATGCTTAAGATGTGAGTGGATGGATCTCAATGAC CTGGCGAAGACTGAAAATACAACTCCCATCACCA | SEQ ID NO: 55 |

TABLE B-continued

| Gene | Locus Link | Sequence | SEQ ID NO |
|---|---|---|---|
| BGN | NM_001711.3 | GAGCTCCGCAAGGATGACTTCAAGGGTCTCCAGCACCTCTACGC CCTCGTCCTGGTGAACAACAAG | SEQ ID NO: 56 |
| BID | NM_001196.2 | GGACTGTGAGGTCAACAACGGTTCCAGCCTCAGGGATGAGTGCA TCACAAACCTACTGGTGTTTGGCTTCC | SEQ ID NO: 57 |
| BIK | NM_001197.3 | ATTCCTATGGCTCTGCAATTGTCACCGGTTAACTGTGGCCTGTG CCCAGGAAGAGCCATTCACTCCTGCC | SEQ ID NO: 58 |
| BIN1 | NM_004305.1 | CCTGCAAAAGGGAACAAGAGCCCTTCGCCTCCAGATGGCTCCC CTGCCGCCACCCCCGAGATCAGAGTCAACCACG | SEQ ID NO: 59 |
| BLMH | NM_000386.2 | GGTTGCTGCCTCCATCAAAGATGGAGAGGCTGTGTGGTTTGGC TGTGATGTTGGAAAACACTTCAATAGCAAGCTGG | SEQ ID NO: 60 |
| BMP2 | NM_001200.1 | ATGTGGACGCTCTTTCAATGGACGTGTCCCCGCGTGCTTCTTA GACGGACTGCGGTCTCCTAAAGGTCGACCATGGT | SEQ ID NO: 61 |
| BMP4 | NM_001202.2 | GGGCTAGCCATTGAGGTGACTCACCTCCATCAGACTCGGACCC ACCAGGGCCAGCATGTCAGGATTAGC | SEQ ID NO: 62 |
| BMP7 | NM_001719.1 | TCGTGGAACATGACAAGGAATTCTTCCACCCACGCTACCACCA TCGAGAGTTCCGGTTTGATCTTTCCA | SEQ ID NO: 63 |
| BMPR1A | NM_004329.2 | TTGGTTCAGCGAACTATTGCCAAACAGATTCAGATGGTCCG GCAAGTTGGTAAAGGCCGATATGGAGA | SEQ ID NO: 64 |
| BRAF | NM_004333.1 | CCTTCCGACCAGCAGATGAAGATCATCGAAATCAATTTGGGCA ACGAGACCGATCCTCATCAGCTCCCAATGTGCATATAAA | SEQ ID NO: 65 |
| BRCA1 | NM_007295.1 | TCAGGGGCTAGAAATCTGTTGCTATGGGCCCTTCACCAACA TGCCCACAGATCAACTGGAATGG | SEQ ID NO: 66 |
| BRCA2 | NM_000059.1 | AGTTCGTGCTTTGCAAGATGGTGCAGAGCTTTATGAAGCAGTG AAGAATGCAGCAGACCCAGCTTACCTT | SEQ ID NO: 67 |
| BRK | NM_005975.1 | GTGCAGGAAAGGTTCACAAATGTGGAGTGTCTGCGTCCAATACAC GCGTGTGCTCCTCTCCTTACTCCATCGTGTGTGC | SEQ ID NO: 68 |
| BTF3 | NM_001207.2 | CAGTGATCCACTTTAACAACCCTAAAGTTCAGGCATCTCTGGCA GCGAACACTTTCACCATTACAGGCCATGCT | SEQ ID NO: 69 |
| BTRC | NM_033637.2 | GTTGGGACACAGTTGGTCTGCAGTCGGCCCAGGACGGTCTACTC AGCACAACTGACTGCTTCA | SEQ ID NO: 70 |
| BUB1 | NM_004336.1 | CCGAGGTTAATCCAGCACGTATGGGGCCAAGTGTAGGCTCCCAG CAGGAACTGAGAGCGCCATGTCTT | SEQ ID NO: 71 |
| BUB1B | NM_001211.3 | TCAACAGAAGGCTGAACCACTAGAAAGACTACAGTCCCAGCACC GACAATTCCAAGCTCGAGTGTCTCGGCAAACTCTGTTG | SEQ ID NO: 72 |
| BUB3 | NM_004725.1 | CTGAAGCAGATGGTTCATCATTTCCTGGGCTGTTAAACAAAGCG AGGTTAAGGTTAGACTCTTGGGAATCAGC | SEQ ID NO: 73 |
| c-abl | NM_005157.2 | CCATCTCGCTGAGATACGAAGGGAGGGTGTACCATTACAGGAT CAACACTGCTTCTGATGGCAAGCTCTACGTCT | SEQ ID NO: 74 |
| c-kit | NM_000222.1 | GAGGCAACTGCTTATGGCTTAATTAAGTCAGATGCGGCCATGA CTGTCGCTGTAAAGATGCTCAAGCCGAGTGCC | SEQ ID NO: 75 |
| c-myb (MYB official) | NM_005375.1 | AACTCAGACTTGGAAATGCCTTCTTTAACTTCCACCCCCCTCA TTGGTCACAAATTGACTGTTACAACACCATTTCATAGAGACCAG | SEQ ID NO: 76 |
| c-Src | NM_005417.3 | TGAGGAGTGGTATTTTGGCAAGATCACCAGACGGGAGTCAGAG CGGTTACTGCTCAATGCAGAGAACCCGAGAG | SEQ ID NO: 77 |
| C20 orf1 | NM_012112.2 | TCAGCTGTGAGCTGCGGATACCGCCCGGCAATGGGACCTG CTCTTAACCTCAAACCTAGGACCGT | SEQ ID NO: 78 |
| C20ORF126 | NM_030815.2 | CCAGCACTGCTCGTTACTGTCTGCCTTCAGTGGTCTGA GGTCCCAGTATGAACTGCCGTGAAGTCAA | SEQ ID NO: 79 |
| C8orf4 | NM_020130.2 | CTACGAGTCAGCCCATCCATCCATGGCTACCACTTCGACAC AGCCTCTCGTAAGAAAGCCGTGGGCA | SEQ ID NO: 80 |
| CA9 | NM_001216.1 | ATCCTAGCCCTGGTTTTTGGCCTCCTTTTTGCTGTCACCAGCGT CGCCGTTCCTTGTGCAGATGAGAAGGCAG | SEQ ID NO: 81 |

TABLE B-continued

| Gene | Locus Link | Sequence | SEQ ID NO |
|---|---|---|---|
| Cad17 | NM_004063.2 | GAAGGCCAAGAACCGAGTCAAATTATATTCCAGTTTAAGGCC AATCCTCCTGCTGTGACTTTTGAACTAACTGGGGA | SEQ ID NO: 82 |
| CALD1 | NM_004342.4 | CACTAAGGTTTGAGACAGTTCCAGAAAGAACCCAAGCTCAAG ACGCAGGACGAGCTCAGTTGTAGAGGGCTAATTCGC | SEQ ID NO: 83 |
| CAPG | NM_001747.1 | GATTGTCACTGATGGGGAGGAGCCTGCTGAGATGATCCAGGTC CTGGGCCCCAAGCCTGCTCTGAAGG | SEQ ID NO: 84 |
| CAPN1 | NM_005186.2 | CAAGAAGCTGTACGAGCTCATCATCACCCGCTACTCGGAGCC CGACCTGGCGGTCGACTTTGACAATTTCGTTTGCTGC | SEQ ID NO: 85 |
| CASP8 | NM_033357.1 | CCTCGGGGATACTGTCTGATCATCAACAATCACAATTTTGCA AAAGCACGGGAGAAAGTGCCCAAACTTC | SEQ ID NO: 86 |
| CASP9 | NM_001229.2 | TGAATGCCGTGGATTGCACGTGGCCTCTTGAGCAGTGGCTGGT CCAGGGCTAGTGACTTGTGTCCCATGATCCCTGT | SEQ ID NO: 87 |
| CAT | NM_001752.1 | ATCCATTCGATCTCACCAAGGTTTGGCCTCACAAGGACTACCCTC TCATCCCAGTTGGTAAACTGGTCTTAAACCGGA | SEQ ID NO: 88 |
| CAV1 | NM_001753.3 | GTGGCTAACATTGTGTTCCCATTTCAGCTGATCAGTGGGCCTC CAAGGAGGGGCTGTAAAATGGAGGCCATTG | SEQ ID NO: 89 |
| CBL | NM_005188.1 | TCATTCACAAACCTGGCAGTTATATCTTCCGGCTGAGCTGTACTC GTCTGGGTCAGTGGGCTATTGGGTATG | SEQ ID NO: 90 |
| CCL20 | NM_004591.1 | CCATGTGCTGTACCAAGAGTTTGCTCCTGGCTGCTTTGATGTC AGTGCTGCTACTCCACCTCTGCGGCG | SEQ ID NO: 91 |
| CCL3 | NM_002983.1 | AGCAGACAGTGGTCAGTCCTTTCTTGGCTCTGCTGACACTCGAG CCCACATTCCGTCACCTGCTCAGAATCATGCAG | SEQ ID NO: 92 |
| CCNA2 | NM_001237.2 | CCATACCTCAAGTATTTGCCATCAGTTATTGCTGGAGCTGCCT TTCATTTAGCACTCTACACAGTCACGGGACAAAGCT | SEQ ID NO: 93 |
| CCNB1 | NM_031966.1 | TTCAGGTTGTTGCAGGAGACCATGTACATGACTGTCTCCATTA TTGATCGGTTCATGCAGAATAATTGTGTGCCCAAGAAGATG | SEQ ID NO: 94 |
| CCNB2 | NM_004701.2 | AGGCTTCTGCAGGAGACTCTGTACATGTGCGTTGGCATTATGG ATCGATTTTTACAGGTTCAGCCAGTTTCCC | SEQ ID NO: 95 |
| CCND1 | NM_001758.1 | GCATGTTCGTGGCCTCTAAGATGAAGGAGACCATCCCCCTGAC GGCCGAGAAGCTGTGCATCTACACCG | SEQ ID NO: 96 |
| CCND3 | NM_001760.2 | CCTCTGTGCTACAGATTATACCTTTGCCATGTACCCGCCATCC ATGATCGCCACGGGCAGCATTGGGGCTGCAGTG | SEQ ID NO: 97 |
| CCNE1 | NM_001238.1 | AAAGAAGATGATGACCGGGTTTACCCAAACTCAACGTGCAAGC CTCGGATTATTGCACCATCCAGAGGCTC | SEQ ID NO: 98 |
| CCNE2 | NM_057749.1 | ATGCTGTGGCTCCTTCCTAACTGGGGCTTTCTTGACATGTAGG TTGCTTGGTAATAACCTTTTTGTATATCACAATTTGGGT | SEQ ID NO: 99 |
| CCNE2 variant 1 | NM_057749var1 | GGTCACCAAGAAACATCAGTATGAAATTAGGAATTGTTGGC CACCTGTATTATCTGGGGGATCAGTCCTTGCATTATCATTGAA | SEQ ID NO: 100 |
| CCR7 | NM_001838.2 | GGATGACATGCACTCAGCTCTTGGCTCCACTGGGATGGGAGGAG AGGACAAGGGAAATGTCAGG | SEQ ID NO: 101 |
| CD105 | NM_000118.1 | GCAGGTGTCAGCAAGTATGATCAGCAATGAGGCGGTGGTCAAT ATCCTGTCGAGCTCATCACCACAGCGGAAAAA | SEQ ID NO: 102 |
| CD134 (TNFRSF4 official) | NM_003327.1 | GCCCAGTGCGGAGAACAGGTCCAGCTTGATTCTCGTCTCTGCA CTTAAGCTGTTCTCCAGGTGCGTGTGATT | SEQ ID NO: 103 |
| CD18 | NM_000211.1 | CGTCAGGACCCACCATGTCTGCCCCATCACGCGGCCGAGACATG GCTTGGCCACAGCTCTTGAGGATGTCACCAATTAACC | SEQ ID NO: 104 |
| CD24 | NM_013230.1 | TCCAACTAATGCCACCACCAAGGCGGCTGGTGGTGCCCTGCAGT CAACAGCCAGTCTCTTCGTGGTCTCACTCTCTC | SEQ ID NO: 105 |
| CD28 | NM_006139.1 | TGTGAAAGGGAAACACCTTTGTCCAAGTCCCCTATTTCCCGGAC CTTCTAAGCCCTTTTGGGTGCT | SEQ ID NO: 106 |

TABLE B-continued

| Gene | Locus Link | Sequence | SEQ ID NO |
|---|---|---|---|
| CD31 | NM_000442.1 | TGTATTTCAAGACCTCTGTGCACTTATTTATGAACCTGCCCTGC TCCCACAGAACACAGCAATTCCTCAGGCTAA | SEQ ID NO: 107 |
| CD34 | NM_001773.1 | CCACTGCACACACCTCAGAGGCTGTTCTTGGGGCCCTACACCTT GAGGAGGGGCAGGTAAACTCCTG | SEQ ID NO: 108 |
| CD3z | NM_000734.1 | AGATGAAGTGGAAGGCGCTTTTCACCGCGGCCATCCTGCAGGCA CAGTTGCCGATTACAGAGGCA | SEQ ID NO: 109 |
| CD44E | X55150 | ATCACCGACAGCACAGACAGAATCCCTGCTACCAATATGGACTC CAGTCATAGTACAACGCTTCAGCCTACTGCAAA TCCAAACACAGGT | SEQ ID NO: 110 |
| CD44s | M59040.1 | GACGAAGACAGTCCCTGGATCACCGACAGCACAGACAGAATC CCTGCTACCAGAGACCAAGACACATTCCACCCCAGT | SEQ ID NO: 111 |
| CD44v3 | AJ251595v3 | CACACAAAACAGAACCAGGACTGGACCCAGTGGAACC CAAGCCATTCAAATCCGGAAGTGCTACTTCAG | SEQ ID NO: 112 |
| CD44v6 | AJ251595v6 | CTCATACCAGCCATCCAATGCAAGGAAGGACAACACCAAGCCC AGAGGACAGTTCCTGGACTGATTTCTTCAACCCAA | SEQ ID NO: 113 |
| CD68 | NM_001251.1 | TGGTTCCCAGCCCTGTGTCCACCTCCAAGCCCAGATTC AGATTCGAGTCATGTACACAACCCAGGGTGGAGGAG | SEQ ID NO: 114 |
| CD80 | NM_005191.2 | TTCAGTTGCTTTGCAGGAAGTGTCTAGAGGAATATGGTGGG CACAGAAGTAGCTCTGGTGACCTTGATCAA | SEQ ID NO: 115 |
| CD82 | NM_002231.2 | GTGCAGGCTCAGGTGAAGTGCTGCGGCTGGGTCAGCTTC TACAACTGGACAGACAACGCTGAGCTCATGAATCGCCCTGAGGTC | SEQ ID NO: 116 |
| CD8A | NM_171827.1 | AGGGTGAGGTGCTTGAGTCTCCAACGGCAAGGGAACAAG TACTTCTTGATACCTGGGATACTGTGCCC | SEQ ID NO: 117 |
| CD9 | NM_001769.1 | GGGCGTGGAACAGTTTATCTCAGACATCTGCCCCAAGAAG GACGTACTCGAAACCTTCACCGTG | SEQ ID NO: 118 |
| CDC2 | NM_001786.2 | GAGAGCGACGCGGTTGTTGTAGCTGCCGCTGCGGCCGC CGCGGAATAATAAGCCGGGATCTACCATAC | SEQ ID NO: 119 |
| CDC20 | NM_001255.1 | TGGATTGGAGTTCTGGGAATGTACTGGCCGTGGCAC TGGACAACAGTGTGTACCTGTGGAGTGCAAGC | SEQ ID NO: 120 |
| cdc25A | NM_001789.1 | TCTTGCTGGCTACGCCTCTTCTGTCCCTGTTAGAC GTCCTCCGTCCATATCAGAACTGTGCCACAATGCAG | SEQ ID NO: 121 |
| CDC25B | NM_021874.1 | AAACGAGCAGTTTGCCATCAGACGCTTCCAGTCTATGCCGG TGAGGCTGCTGGGCCACAGCCCCGTGCTTCGGAACATCACCAAC | SEQ ID NO: 122 |
| CDC25C | NM_001790.2 | GGTGAGCAGAAGTGGCCTATATCGCTCCCCGTCGATGCCAG AGAACTTGAACAGGCCAAGACTGAAG | SEQ ID NO: 123 |
| CDC4 | NM_018315.2 | GCAGTCCGCTGTGTTCAATATGATGGCAGGAGGGTTGTTAGT GGAGCATATGATTTTATGGTAAAGGTGTGGGATCC | SEQ ID NO: 124 |
| CDC42 | NM_001791.2 | TCCAGAGACTGCTGAAAAGCTGGCCCGTGACCTGAAGGCTG TCAAGTATGTGGAGTGTTCTGCACTTACACA | SEQ ID NO: 125 |
| CDC42BPA | NM_003607.2 | GAGCTGAAAGACGCACACTGTCAGAGGAAACTGGCCAT GCAGGAATTCATGGAGATCAATGAGCGGC | SEQ ID NO: 126 |
| CDC6 | NM_001254.2 | GCAACACTCCCCATTTACCTCCTTGTTCTCCACCAAAGCAAG GCAAGAAAGAGAATGGTCCCCCTCA | SEQ ID NO: 127 |
| CDCA7v2 | NM_145810.1 | AAGACCGTGGATGGCTACATGAATGAAGATGACCTGCCC AGAAGCCGTCGCTCCAGATCATCCGTGACCCT | SEQ ID NO: 128 |
| CDH1 | NM_004360.2 | TGAGTGTCCCCCGGTATCTTCCCCGCCCTGCCAATCCCGATGA AATTGGAAATTTTATTGATGAAAATCTGAAAGCGGCTG | SEQ ID NO: 129 |
| CDH11 | NM_001797.2 | GTCGGCAGAAGCAGGACTTGTACCTTCTGCCCATAGTGATCA GCGATGGCGGCATCCCGCCCATGAGTAG | SEQ ID NO: 130 |
| CDH3 | NM_001793.3 | ACCCATGTACCGTCCTCGGCCAGCCAACCCAGATGAAATCGGC AACTTTATAATTGAGAACCTGAAGGCGG | SEQ ID NO: 131 |

TABLE B-continued

| Gene | Locus Link | Sequence | SEQ ID NO |
|---|---|---|---|
| CDK2 | NM_001798.2 | AATGCTGCACTACGACCCTAACAAGCGGATTTCGGCCAAGGCA GCCCTGGCTCACCCTTTCTTCCAGGATGTGACCAA | SEQ ID NO: 132 |
| CDX1 | NM_001804.1 | AGCAACACCAGCCTCCTGGCCACCTCCTCTCCAATGCCTGTGAA AGAGGAGTTTCTGCCATAGCCC | SEQ ID NO: 133 |
| Cdx2 | NM_001265.2 | GGGCAGGCAAGGTTTACACTGCGGAAGCCAAAGGCAGCTAA GATAGAAAGCTGGACTGACCAAAGAC | SEQ ID NO: 134 |
| CEACAM1 | NM_001712.2 | ACTTGCCTGTTCAGAGCACTCATTCCTTCCCACCCCCAGT CCTGTCCTATCACTCTAATTCGGATTTGCCA | SEQ ID NO: 135 |
| CEACAM6 | NM_002483.2 | CACAGCCTCACTTCTAACCTTCTGGAACCCACCCACCACT GCCAAGCTCACTATTGAATCCACGCCATTCAA | SEQ ID NO: 136 |
| CEBPB | NM_005194.2 | GCAACCCACGTGTAACTGTCAGCCGGGCCCTGAGTAATCGCT TAAAGATGTTCCTACGGGCTTGT | SEQ ID NO: 137 |
| CEGP1 | NM_020974.1 | TGACAATCAGCACACCTGCATTCACCGCTCGGAAGAGGGCC TGAGCTGCATGAATAAGGATCACGGCTGTAGTCACA | SEQ ID NO: 138 |
| CENPA | NM_001809.2 | TAAATTCACTCGTGGTGTGGACTTCAATTGGCAAGCCCAGG CCCTATTGGCCCTACAAGAGGC | SEQ ID NO: 139 |
| CENPE | NM_001813.1 | GGATGCTGGTGACCTCTTCTTCCCTCACGTTGCAACAGGAATTAA AGGCTAAAAGAAAACGAAGAGTTACTTGGTGCCTTGGC | SEQ ID NO: 140 |
| CENPF | NM_016343.2 | CTCCCGTCAACAGCGTTCTTTCCAAACACTGGACCAGGAGTGC ATCCAGATGAAGGCCAGACTCACCC | SEQ ID NO: 141 |
| CES2 | NM_003869.4 | ACTTTGCGAGAAATGGGAACCCCAATGGCGAGGGTCTGCCACAC TGGCCGCTGTTCGACCAGGAGGAGCAATACCTG | SEQ ID NO: 142 |
| CGA (CHGA official) | NM_001275.2 | CTGAAGGAGCTCCAAGACCTCGCTCTCCAAGGCGCCAAGG AGAGGGCACATCAGCAGAAGAAACACAGCGGTTTTG | SEQ ID NO: 143 |
| CGB | NM_000737.2 | CCACCATAGGCAGAGGCAGGCCTTCCTACACCCTACTCCCTG TGCCTCCAGCCTCGACTAGTCCCTAGCACTCGACGACT | SEQ ID NO: 144 |
| CHAF1B | NM_005441.1 | GAGGCCAGTGGTGGAAACAGGTGTGGAGCTGATGAGTCT GCCCTACCGCCTGGTGTTTGCTGTGGCCTCGGA | SEQ ID NO: 145 |
| CHD2 | NM_001271.1 | CTCTGTGCGAGGCTGTCAGCCACACTAGGTATCAGGGATCC CGAGATGGGTACCAGCCCACAGTCCTTACC | SEQ ID NO: 146 |
| CHFR | NM_018223.1 | AAGGAAGTGGTCCCTCTGTGGCAAGTGATGAAGTCTCCAGC TTTGCCTCAGCTCTCCCAGACAGAAAGACTGCGTC | SEQ ID NO: 147 |
| Chk1 | NM_001274.1 | GATAAATTGGTACAAGGGATCAGCTTTTCCCAGCCCACATG TCCTGATCATATGCTTTTGAATAGTCAGTTACTTGGCACCC | SEQ ID NO: 148 |
| Chk2 | NM_007194.1 | ATGTGGAACCCCCACCTACTTGGCGCCTGAAGTTCTTGTTT CTGTTGGGACTGCTGGGTATAACCGTGCTGTGGACTG | SEQ ID NO: 149 |
| CIAP1 | NM_001166.2 | TGCCTGTGGTGGGAAGCTCAGTAACTGGGAACCAAAGGATG ATGCTATGTCAGAACACCGGAGGCATTTTCC | SEQ ID NO: 150 |
| cIAP2 | NM_001165.2 | GGATATTTCCGTGGCTCTTATTCAAACTCTCCATCAAATCC TGTAAACTCCAGAGCAAATCAAGATTTTTCTGCCTTGATGAGAAG | SEQ ID NO: 151 |
| CKS1B | NM_001826.1 | GGTCCCTAAAACCCATCTGATGTCTGAATCGAATGGAGGAAT CTTGGCGTTCAGCAGAGTCAGGGATGGGTCCATTA | SEQ ID NO: 152 |
| CKS2 | NM_001827.1 | GGCTGGACGTGGTTTTGTCTGCTGCGCCCGCTCTTCGCG CTCTCGTTTCATTTTCTGCAGCG | SEQ ID NO: 153 |
| Claudin 4 | NM_001305.2 | GGCTGCTTTGCTGCAACTGTCCACCCCGCACAGACAA GCCTTACTCCGCCAAGTATTCTGCTGCCCGCTCTG | SEQ ID NO: 154 |
| CLDN1 | NM_021101.3 | TCTGGGAGGTGCCCTACTTTGCTGTTCCTGTCCCGAAAAA CAACCTCTTACCCAACACCAAGGCCCTATCCA | SEQ ID NO: 155 |
| CLDN7 | NM_001307.3 | GGTCTGCCCTAGTCATCCTGGGAGGTGCACTGCTCTCCTGT TCCTGTCCTGGGAATGAGAGCAAGGCTGGGTAC | SEQ ID NO: 156 |

TABLE B-continued

| Gene | Locus Link | Sequence | SEQ ID NO |
|---|---|---|---|
| CLIC1 | NM_001288.3 | CGGTACTTGAGCAATGCCTACGCCCGGGAAGAATTCGCTTC CACCTGTCCAGATGATGAGGAGATCGA | SEQ ID NO: 157 |
| CLTC | NM_004859.1 | ACCGTATGGACAGCCACAGCCTGGCTTTGGGTACAGCATGTGA GATGAAGCGCTGATCCTGTAGTCA | SEQ ID NO: 158 |
| CLU | NM_001831.1 | CCCCAGGATACCTACCACTACCTGCCCTTCAGCCTGCCCCACCG GAGGCCTCACTTCTTCTTTCCCAAGTCCCGCA | SEQ ID NO: 159 |
| cMet | NM_000245.1 | GACATTTCCAGTCCTGCAGTCAATGCCTCTCTGCCCCACCTT TGTTCAGTGTGGCTGGTGCCACGACAAATGTGTGCGATCGGAG | SEQ ID NO: 160 |
| cMYC | NM_002467.1 | TCCCTCCACTCGGAAGGACTATCCTGCTGCCAAGAGGGTCAAGT TGGACAGTGTCAGAGTCCTGAGACAGATCAGCAACAACCG | SEQ ID NO: 161 |
| CNN | NM_001299.2 | TCCACCCTCCTGGCTTTGGCCAGCATGGCGAAGACGAAAGG AAACAAGGTGAACGTGGGAGTGA | SEQ ID NO: 162 |
| COL1A1 | NM_000088.2 | GTGGCCATCCAGCTGACCTTCCTGCGCCTGATGTCC ACCGAGGCCTCCCAGAACATCACCTACCACTG | SEQ ID NO: 163 |
| COL1A2 | NM_000089.2 | CAGCCAAGAACTGGTATAGGAGCTCCAAGGACAAGAA ACACGTCTGGCTAGGAGAAACTATCAATGCTGGCAGCCAGTTT | SEQ ID NO: 164 |
| COPS3 | NM_003653.2 | ATGCCCAGTGTTCCTGACTTCGAAACGCTATTCTCACAG GTTCAGCTCTTCATCAGCACTTGTAATGGGAG | SEQ ID NO: 165 |
| COX2 | NM_000963.1 | TCTGCAGAGTTGGAAGCACTCTATGGTGACATCGATGCT GTGGAGCTGTATCCTGCCCTTCTGGTAGAAAAGCCTCGGC | SEQ ID NO: 166 |
| COX3 | MITO_COX3 | TCGAGTCTCCCTTCACCATTTCCGACGGCATCTACGGCTCAAC ATTTTTTGTAGCCACAGGCTTCCACGGACTTCACGTC | SEQ ID NO: 167 |
| CP | NM_000096.1 | CGTGAGTACACAGATGCCTCCTTCACAAATCGAAAGGAGAGAGG CCCTGAAGAAGAGCATCTTGGCATCCTGG | SEQ ID NO: 168 |
| CRBP | NM_002899.2 | TGGTCTGCAAGCAAGTATTCAAGAAGGTGCAGTGAGGCCCAAGC AGACAACCTTGTCCCAACCAATCAGC | SEQ ID NO: 169 |
| CREBBP | NM_004380.1 | TGGGAAGCAGCTGTGTACCATTCCTCGCGATGCTGCCTACTA CAGCTATCAGAATAGGTATCATTTCTGTGAGAAGTGTTTC | SEQ ID NO: 170 |
| CRIP2 | NM_001312.1 | GTGCTACGCCACCCTGTTCGGACCCAAAGGCGTGAACATCGGG GGCGCGGGCTCCTACATCTACGAGAAGCCCCTG | SEQ ID NO: 171 |
| cripto (TDGF1 official) | NM_003212.1 | GGGTCTGTGCCCCATGACACCTGGCTGCCCAAGAAGTGTTC CCTGTGTAAATGCTGGCACGGTCA | SEQ ID NO: 172 |
| CRK(a) | NM_016823.2 | CTCCCTAACCTCCAGAATGGGCCCATATATGCCAGGGTTATC CAGAAGCGAGTCCCCAATGCCTACGACAAGACA | SEQ ID NO: 173 |
| CRMP1 | NM_001313.1 | AAGGTTTTTGGATTGCAAGGGGTTTCCAGGGGCATGTATGACGG TCCTGTGTACGAGGTACCAGCTACACCC | SEQ ID NO: 174 |
| CRYAB | NM_001885.1 | GATGTGATTGAGGTGCATGGAAAACATGAAGAGCGCCAGGATGA ACATGGTTTCATCTCCAGGGAGTTC | SEQ ID NO: 175 |
| CSEL1 | NM_001316.2 | TTACGCAGCTCATGCTCTTGAACGGCTCTTTACTATGCGAGGGC CTAACAATGCCACTCTCTTTACAGCTGC | SEQ ID NO: 176 |
| CSF1 | NM_000757.3 | TGCAGCGGCTGATTGACAGTCAGATGGAGACCTCGTGCCAAATTA CATTTGAGTTTGTAGACCAGGAACAGTTG | SEQ ID NO: 177 |
| CSK (SRC) | NM_004383.1 | CCTGAACATGAAGGAGCTGAAGCTGCTGCAGACCATCGGGA AGGGGGAGTTCGGAGACGTGATG | SEQ ID NO: 178 |
| CTAG1B | NM_001327.1 | GCTCTCCATCAGCTCCTGTCTCCAGCAGCTTTCCCTGTTGATGT GGATCACGCAGTGCTTTCTGCCCGTGTT | SEQ ID NO: 179 |
| CTGF | NM_001901.1 | GAGTTCAAGTGCCCTGACGGCGAGGTCATGAAGAAGAACA TGATGTTCATCAAGACCTGTGCCTGCCATTACAACT | SEQ ID NO: 180 |
| CTHRC1 | NM_138455.2 | GCTCACTTCGGCTAAAATGCAGAAATGCATGCTGTCAGCGTTGGT ATTTCACATTCAATGGAGCTGA | SEQ ID NO: 181 |

TABLE B-continued

| Gene | Locus Link | Sequence | SEQ ID NO |
|---|---|---|---|
| CTLA4 | NM_005214.2 | CACTGAGGTCCGGGTGACAGTGCTTCGGCAGGCTGACAGCCAGGT GACTGAAGTCTGTGCGGCAACCTAC | SEQ ID NO: 182 |
| CTNNBIP1 | NM_020248.2 | GTTTTCCAGGTCGGAGACGGAAGACCGGAGGCAGTAGCTGCA AAGCCCTTGGAACACCCTGGATGCT | SEQ ID NO: 183 |
| CTSB | NM_001908.1 | GGCCGAGATCTACAAAAACGGCCCCGTGGAGGGAGCTTTCTCTG TGTATTCGGACTTCCTGC | SEQ ID NO: 184 |
| CTSD | NM_001909.1 | GTACATGATCCCCTGTGAGAAGGTGTCCACCCTGCCCGCGATC ACACTGAAGCTGGGAGGCAAAGGCTACAAGCTGTCCC | SEQ ID NO: 185 |
| CTSH | NM_004390.1 | GCAAGTTCCAACCTGGAAAGGCCATCGGCTTTGTCAAGGATGT AGCCAACATCACAATCTATGACGAGGAAGCGATG | SEQ ID NO: 186 |
| CTSL | NM_001912.1 | GGGAGGCTTATCTCACTGAGTGAGCAGAATCTGGTAGACTGC TCTGGGCCTCAAGGCAATGAAGGCTGCAATGG | SEQ ID NO: 187 |
| CTSL2 | NM_001333.2 | TGTCTCACTGAGCGAGCAGAATCTGGTGGACTGTTCGCGTC CTCAAGGCAATCAGGGCTGCAATGGT | SEQ ID NO: 188 |
| CUL1 | NM_003592.2 | ATGCCCTGGTAATGTCTGCATTCAACAATGACGCTGGCTTTG TGGCTGCTCTTGATAAGGCTTGTGGTCGC | SEQ ID NO: 189 |
| CUL4A | NM_003589.1 | AAGCATCTTCCTGTTCTTGGACCGCACCTATGTGCTGCAGA ACTCCACGCTGCCCTCCATCTGGGATATGGGATT | SEQ ID NO: 190 |
| CXCL12 | NM_000609.3 | GAGCTACAGATGCCCATGCCGATTCTTCGAAAGCCATGTT GCCAGAGCCAACGTCAAGCATCTCAAA | SEQ ID NO: 191 |
| CXCR4 | NM_003467.1 | TGACCGCTTCTACCCCAATGACTTGTGGGTGGTTGTGTTCC AGTTTCAGCACATCATGGTTGGCCTTATCCT | SEQ ID NO: 192 |
| CYBA | NM_000101.1 | GGTGCCTACTCCATTGTGGCGGGCGTGTTTGTGTGCCTGCTGG AGTACCCCGGGGAAGAGGAAGAAGGGCTCCAC | SEQ ID NO: 193 |
| CYP1B1 | NM_000104.2 | CCAGCTTTGTGCCTGTCACTATTCCTCATGCCACCACTGCC AACACCTCTGTCTTGGGCTACCACATTCCC | SEQ ID NO: 194 |
| CYP2C8 | NM_000770.2 | CCGTGTTCAAGAGGAAGCTCACTGCCTTGTGGAGGAGTTGA GAAAAACCAAGGCTTCACCCTGTGATCCCACT | SEQ ID NO: 195 |
| CYP3A4 | NM_017460.3 | AGAACAAGGACAACATAGATCCTTACATATACACACCCTTT GGAAGTGGACCCAGAAACTGCATTGGCATGAGGTTTGC | SEQ ID NO: 196 |
| CYR61 | NM_001554.3 | TGCTCATTCTTGAGGAGCATTAAGGTATTTCGAAACTGCCAA GGGTGCTGGTGCGGATGGACACTAATGCAGCCAC | SEQ ID NO: 197 |
| DAPK1 | NM_004938.1 | CGCTGACATCATGAATGTTCCTCGACCGGCTGGAGGCGAGTTT GGATATGACAAAGACACATCGTTGCTGAAAGAGA | SEQ ID NO: 198 |
| DCC | NM_005215.1 | AAATGTCCTCCTCGACTGCTCCGCGGAGTCCGACCGAGGAGTTCC AGTGATCAAGTGGAAGAAAGATGGCATTCA | SEQ ID NO: 199 |
| DCC_exons18-23 | X76132_18-23 | GGTCACCGTTGGTGTCATCACAGTGCTGGTAG TGGTCATCGTGGCTGTGATTTGCACCCGACGCTC | SEQ ID NO: 200 |
| DCC_exons6-7 | X76132_6-7 | ATGGAGATGTGGTCATTCCTAGTGATTATTTTCAG ATAGTGGGAGGAAGCAACTTACGGATACTTGGGGTGGTG | SEQ ID NO: 201 |
| DCK | NM_000788.1 | GCCGCCACAAGACTAAGGAATGGCCACCCCGCCCAAGAGAAGC TGCCCGTCTTTCTCAGCCAGCTCTGAGGGGACCCGC ATCAAGAAAATCTCCATCGAAGGGAACATCG | SEQ ID NO: 202 |
| DDB1 | NM_001923.2 | TGCGGATCATCCGGAATGGAATTGGAATCCACGAGCATGCC AGCATTGACTTACCAGGCATCAAAGGA | SEQ ID NO: 203 |
| DET1 | NM_017996.2 | CTTGTGGAGATCACCCAATCAGGTTCTATGCCCGGGACTCG GGCCTGCTCAAGTTTGAGATCCAGGCGGG | SEQ ID NO: 204 |
| DHFR | NM_000791.2 | TTGCTATAACTAGTGCTTCTCCAAGACCCCAACTGAGTCC CCAGCACCTGCTACAGTGAGCTGCCATTCCAC | SEQ ID NO: 205 |
| DHPS | NM_013407.1 | GGGAGAACGGGATCAATAGGATCGGAAACCTGCTGGTGCCC AATGAGAATTACTGCAAGTTTGAGGACTGGCTGATGC | SEQ ID NO: 206 |

TABLE B-continued

| Gene | Locus Link | Sequence | SEQ ID NO |
|---|---|---|---|
| DIABLO | NM_019887.1 | CACAATGGCGGCTCTGAAGAGTTGGCTGTCGCGCAGCGTA ACTTCATTCTTCAGGTACAGACAGTGTTTGTGT | SEQ ID NO: 207 |
| DIAPH1 | NM_005219.2 | CAAGCAGTCAAGGAGAACCAGAAGCGGCGGGAGACAGAAG AAAAGATGAGGCGAGCAAAACT | SEQ ID NO: 208 |
| DICER1 | NM_177438.1 | TCCAATTCCAGCATCACTGTGGAGAAAAGCTGTTTGTCTCC CCAGCATACTTTATCGCCTTCACTGCC | SEQ ID NO: 209 |
| DKK1 | NM_012242.1 | TGACAACTACCAGCCGTACCCGTGCGCAGAGGACGAGGAGTGC GGCACTGATGAGTACTGCGCTAGTCCC | SEQ ID NO: 210 |
| DLC1 | NM_006094.3 | GATTCAGACGAGGATGAGCCTTGTGCCATCAGTGGCAAATGG ACTTTCCAAAGGGACAGCAAGAGGTG | SEQ ID NO: 211 |
| DPYD | NM_000110.2 | AGGACGCAAGGAGGGTTTGTCACTGGCAGACTCGAGACTGTAG GCACTGCCATGGCCCCTGTGCTCAGTAAGGACTCGGCGGACATC | SEQ ID NO: 212 |
| DR4 | NM_003844.1 | TGCACAGAGGGTGTGGGTTACACCAATGCTTCCAACAATTTGTT TGCTTGCCTCCCATGTACAGCTTGTAAATCAGATGAAGA | SEQ ID NO: 213 |
| DR5 | NM_003842.2 | CTCTGAGACAGTGCTTCGATGACTTTGCAGACTTGGTGCCCTTTG ACTCCTGGGAGCCGCTCATGAGGAAGTTGGGCCTCATGG | SEQ ID NO: 214 |
| DRG1 | NM_004147.3 | CCTGGATCTCCCAGGTATCATTGAAGGTGCCAAGGATGGGAAAG GTAGAGGTCGTCAAGTCATTGCA | SEQ ID NO: 215 |
| DSP | NM_004415.1 | TGGCACTACTGCATGATTGACATAGAGAAGATCAGGGCCATGA CAATCGCCAAGCTGAAAACAATGCGGCAGG | SEQ ID NO: 216 |
| DTYMK | NM_012145.1 | AAATCGCTGGGAACAAGTGCCGTTAATTAAGGAAAAGTTGA GCCAGGGCGTGACCCTCGTCGTGGACAGATACGCATT | SEQ ID NO: 217 |
| DUSP1 | NM_004417.2 | AGACATCAGCTCCTGGTTCAACGAGGCCATTGACTTCATAGA CTCCATCAAGAATGCTGGAGGAAGGGTGTTTGTC | SEQ ID NO: 218 |
| DUSP2 | NM_004418.2 | TATCCCTGTGGAGGACAACCAGATGGTGGAGATCAGTGCCTG GTTCCAGGAGGCCATAGGCTTCATTGACTGGGTG | SEQ ID NO: 219 |
| DUT | NM_001948.2 | ACACATGGAGTGCTTCTGGAACTATCAGCCCACTTGACCACCCA GTTTGTGGAAGCACAGGCAAGAG | SEQ ID NO: 220 |
| DYRK1B | NM_004714.1 | AGCATGACACGGAGATGAAGTACTATATAGTACACCTGAAG CGGCACTTCATGTTCCGGAACCACCTGTGCCTGGTATT | SEQ ID NO: 221 |
| E2F1 | NM_005225.1 | ACTCCCTCTACCCTTGAGCAAGGGCAGGGGTCCCTGAGCTGTT CTTCTGCCCCATACTGAAGGAACTGAGGCCTG | SEQ ID NO: 222 |
| EDN1 endothelin | NM_001955.1 | TGCCACCTGGACATCATTTGGGTCAACACTCCCGAGCACGTTG TTCCGTATGGACTTGGAAGCCCTAGGTCCA | SEQ ID NO: 223 |
| EFNA1 | NM_004428.2 | TACATCTCCAAACCCATCCACCAGCATGAAGACCGCTGCTTG AGGTTGAAGGTGACTGTCAGTGGCAA | SEQ ID NO: 224 |
| EFNA3 | NM_004952.3 | ACTACATCTCCACGCCCACTCACAACCTGCACTGGAAGTGTCT GAGGATGAAGGTGTTCGTCTGCTG | SEQ ID NO: 225 |
| EFNB1 | NM_004429.3 | GGAGCCCGTATCCTGGAGCTCCCTCAACCCCAAGTTCCTGAGT GGGAAGGGCTTGGTGATCTATCC | SEQ ID NO: 226 |
| EFNB2 | NM_004093.2 | TGACATTATCATCCCGCTAAGGACTGCGGACAGCGTCTTCTGC CCTCACTACGAGAAGGTCAGCGGGGACTAC | SEQ ID NO: 227 |
| EFP | NM_005082.2 | TTGAACAGAGCCTGACCAAGAGGGATGAGTTCGAGTTTCTGGAG AAAGCATCAAAACTGCGAGGAATCTCAACA | SEQ ID NO: 228 |
| EGFR | NM_005228.1 | TGTCGATGGACTTCCAGAACCACCTGGGCAGCTGCCAAAAGTG TGATCCAAGCTGTCCCAAT | SEQ ID NO: 229 |
| EGLN1 | NM_022051.1 | TCAATGGCCGGACGAAAGCCATGGTTGCTTGTTATCCGGGCA ATGGAACGGGTTATGTACGTCATGTTGATAATCCAAA | SEQ ID NO: 230 |
| EGLN3 | NM_022073.2 | GCTGGTCCTCTACTGCGGGAGCCGGCTGGGCAAATACTACGT CAAGGAGAGGTCTAAGGCAATGGTGG | SEQ ID NO: 231 |
| EGR1 | NM_001964.2 | GTCCCCGCTGCAGATCTCTGACCCGTTCGGATCCTTTCCTCAC TCGCCCACCATGGACAACTACCCTAAGCTGGAG | SEQ ID NO: 232 |

TABLE B-continued

| Gene | Locus Link | Sequence | SEQ ID NO |
|---|---|---|---|
| EGR3 | NM_004430.2 | CCATGTGGATGAATGAGGTGTCTCCTTTCCATACCCAGTCTCA CCTTCTCCCCACCCTACCTCACCTCTTCTCAGGCA | SEQ ID NO: 233 |
| EI24 | NM_004879.2 | AAAGTGGTGAATGCCATTTGGTTTCAGGATATAGCTGACCTG GCATTTGAGGTATCAGGGAGGAAGCCTCAC | SEQ ID NO: 234 |
| EIF4E | NM_001968.1 | GATCTAAGATGGCGACTGTCGAACCGGAAACCACCCCTACT CCTAATCCCCCGACTACAGAAGAGGAGAAAACGGAATCTAA | SEQ ID NO: 235 |
| EIF4EL3 | NM_004846.1 | AAGCCGCGGTTGAATGTGCCATGACCCTCTCCCTCTCTG GATGGCACCATCATTGAAGCTGGCGTCA | SEQ ID NO: 236 |
| ELAVL1 | NM_001419.2 | GACAGGAGGCCTCTATCCTGTCCCTCCACCCCACCCTCCA CCTCAATCCCCTCCCATCTTCCCCAGACCTACCTCAC | SEQ ID NO: 237 |
| EMP1 | NM_001423.1 | GCTAGTACTTTGATGCTCCCTTGATGGGGTCCAGAGAGCCTC CCTGCAGCCACCAGACTTGGCCTCCAGCTGTTC | SEQ ID NO: 238 |
| EMR3 | NM_032571.2 | TGGCCTACCTCTTCACCATCATCAACAGCCTCCAAGGCTTCTT CATCTTCTTGGTCTACTGCCTCCTCA | SEQ ID NO: 239 |
| EMS1 | NM_005231.2 | GGCAGTGTCACTGAGTCCTTGAAATCCTCCCCTGCCCCGCGGG TCTCTGGATTGGGACGCACAGTGCA | SEQ ID NO: 240 |
| ENO1 | NM_001428.2 | CAAGGCCGTGAACGAGAAGTCCTGCAACTGCCTCCTGCTCAAA GTCAACCAGATTGGCTCCGTGACCG | SEQ ID NO: 241 |
| EP300 | NM_001429.1 | AGCCCCAGCAACTACAGTCTGGGATGCCAAGGCCAGCCATGA TGTCAGTGGCCCAGCATGGTCAACCTTTGAACA | SEQ ID NO: 242 |
| EPAS1 | NM_001430.3 | AAGCCTTGGAGGGTTTCATTGCCGTGGTGACCCAAGATGGCG ACATGATCTTTCTGTCAGAAACATCAGCA | SEQ ID NO: 243 |
| EpCAM | NM_002354.1 | GGGCCCTCCAGAACAATGATGGGCTTTATGATCCTGACTGCG ATGAGAGCGGGCTCTTTAAGGCCAAGCAGTGCA | SEQ ID NO: 244 |
| EPHA2 | NM_004431.2 | CGCCTGTTCACCAAGATTGACACCATTGCGCCCGATGAGATC ACCGTCAGCAGCGACTTCGAGGCACGCCAC | SEQ ID NO: 245 |
| EPHB2 | NM_004442.4 | CAACCAGGCAGCTCCATCGGCAGTGTCCATCATGCATCAGGT GAGCCGCACCGTGGACAGCATTAC | SEQ ID NO: 246 |
| EPHB4 | NM_004444.3 | TGAACGGGGTATCCTCCTTAGCCACGGGGCCCGTCCCATTTG AGCCTGTCAATGTCACCACTGACCGAGAGGTACCT | SEQ ID NO: 247 |
| EphB6 | NM_004445.1 | ACTGGTCCTCCATCGGCTCCCCAGGAGCTTTGGTTTGAGGTG CAAGGCTCAGCACTCATGCTACACTGG | SEQ ID NO: 248 |
| EPM2A | NM_005670.2 | ACTGTGGCACTTAGGGGAGATGACATTTGCTTTGGGCAGAGG CAGCTAGCCAGGACACATTTCCACT | SEQ ID NO: 249 |
| ErbB3 | NM_001982.1 | CGGTTATGTCATGCCAGATACACACCTCAAAGGTACTCCCTC CTCCCGGGAAGGCACCCTTTCTTCAGTGGGTCTCAGTTC | SEQ ID NO: 250 |
| ERCC1 | NM_001983.1 | GTCCAGGTGGATGTGAAAGATCCCCAGCAGGCCCTCAAGGAG CTGGCTAAGATGTGTATCCTGGCCG | SEQ ID NO: 251 |
| ERCC2 | NM_000400.2 | TGGCCTTCTTCACCAGCTACCAGTACATGGAGAGCACCGTGG CCTCCTGGTATGAGCAGGGGATCCTTG | SEQ ID NO: 252 |
| EREG | NM_001432.1 | ATAACAAAGTGTAGCTCTGACATGAATGGCTATTGTTTGCATG GACAGTGCATCTATCTGGTGGACATGAGTCAAAACTACTGCAGGTGTG | SEQ ID NO: 253 |
| ERK1 | Z11696.1 | ACGGATCACAGTGGAGGAAGCGCTGGCTCACCCCTACCTGGA GCAGTACTATGACCCGACGGATGAG | SEQ ID NO: 254 |
| ERK2 | NM_002745.1 | AGTTCTTGACCCCTGGTCCTGTCTCCAGCCCGTCTTGGCTT ATCCACTTTGACTCCTTTGAGCCGTTT | SEQ ID NO: 255 |
| ESPL1 | NM_012291.1 | ACCCCAGACCGGATCAGGCAAGCTGGCCCTCATGTCCCC TTCACGGTGTTTGAGGAAGTCTGCCCTACA | SEQ ID NO: 256 |
| EstR1 | NM_000125.1 | CGTGGTGCCCCTCTATGACCTGCTGCTGGAGATGCTGGAC GCCCACCGCCTACATGCGCCCACTAGCC | SEQ ID NO: 257 |
| ETV4 | NM_001986.1 | TCCAGTGCCTATGACCCCCCCAGACAAATCGCCATCAAGTC CCCTGCCCCTGGTGCCCTTGGACAGT | SEQ ID NO: 258 |

TABLE B-continued

| Gene | Locus Link | Sequence | SEQ ID NO |
|---|---|---|---|
| F3 | NM_001993.2 | GTGAAGGATGTGAAGCAGACGTACTTGGCACGGGTCTTCTCCT ACCCGGCAGGGAATGTGGAGAGCACCGGTT | SEQ ID NO: 259 |
| FABP4 | NM_001442.1 | GCTTTGCCACCAGGAAAGTGGCTGGCATGGCCAAACCTAA CATGATCATCAGTGTGAATGGGATG | SEQ ID NO: 260 |
| FAP | NM_004460.2 | CTGACCAGAACCACGGCTTATCCGGCCTGTCCACGAACCACT TATACACCCACATGACCCACTTCC | SEQ ID NO: 261 |
| fas | NM_000043.1 | GGATTGCTCAACAACCATGCTGGGCATCTGGACCCTCCTACC TCTGGTTCTTACGTCTGTTGCTAGATTATCGTCCAAAAGTGTTAATGCC | SEQ ID NO: 262 |
| fasl | NM_000639.1 | GCACTTTGGGATTCTTTCCATTATGATTCTTTGTTACAGGCAC CGAGAATGTTGTATTCAGTGAGGGTCTTCTTACATGC | SEQ ID NO: 263 |
| FASN | NM_004104.4 | GCCTCTTCCTGTTCGACGGCTCGCCCACCTACGTACTGGCCTA CACCCAGAGCTACCGGGCAAAGC | SEQ ID NO: 264 |
| FBXO5 | NM_012177.2 | GGCTATTCCTCATTTTCTCTACAAAGTGGCCTCAGTGAACAT GAAGAAGGTAGCCTCCTGGAGGAGAATTTCGGTGACAGTCTACAATCC | SEQ ID NO: 265 |
| FBXW7 | NM_033632.1 | CCCCAGTTTCAACGAGACTTCATTTCATTGCTCCCTAAAGAGT TGGCACTCTATGTGCTTTCATTCCTGGAAC | SEQ ID NO: 266 |
| FDXR | NM_004110.2 | GAGATGATTCAGTTACCGGGAGCCCGGCCCATTTTGGATCCTGT GGATTTCTTGGGTCTCCAGGACAAGAT | SEQ ID NO: 267 |
| FES | NM_002005.2 | CTCTGCAGGCCTAGGTGCAGCTCCTCAGCGGCTCCAGCTCATAT GCTGACAGCTCTTCACAGTCCTGG | SEQ ID NO: 268 |
| FGF18 | NM_003862.1 | CGGTAGTCAAGTCCGGATCAAGGGCAAGGAGACGGAATTCTA CCTGTGCATGAACCGCAAAGGCAAGC | SEQ ID NO: 269 |
| FGF2 | NM_002006.2 | AGATGCAGGAGAGAGGAGCCTTGCAAACCTGCAGACTGCTTT TTGCCCAATATAGATTGGGTAAGGCTGCAAAAC | SEQ ID NO: 270 |
| FGFR1 | NM_023109.1 | CACGGGACATTCACCACATCGACTACTATAAAAAGACAACCA ACGGCCGACTGCCTGTGAAGTGGATGGCACCC | SEQ ID NO: 271 |
| FGFR2 isoform 1 | NM_000141.2 | GAGGGACTGTTGGCATGCAGTGCCCTCCCAGAGACCAACGTT CAAGCAGTTGGTAGAAGACTTGGATCGAATTCTCACTC | SEQ ID NO: 272 |
| FHIT | NM_002012.1 | CCAGTGGAGCGCTTCCATGACCTGCGTCCTGATGAAGTGGCCGA TTTGTTTCAGACGACCCAGAGAG | SEQ ID NO: 273 |
| FIGF | NM_004469.2 | GGTTCCAGCTTTCTGTAGCTGTAAGCATTGGTGGCCACACCAC CTCCTTACAAAGCAACTAGAACCTGCGGC | SEQ ID NO: 274 |
| FLJ12455 | NM_022078.1 | CCACCAGCATGAAGTTTCGGACAGACATGGCCTTTGTGA GGGGTTCCAGTTGTGCTTCAGACAGCC | SEQ ID NO: 275 |
| FLJ20712 | AK000719.1 | GCCACACAAACATGCTCCTGCTCCTGGCGGAGGCAGAGCTGCTG GGAAAGACATTTCGGAAGTTTCCTGTGGC | SEQ ID NO: 276 |
| FLT1 | NM_002019.1 | GGCTCCCGAATCTATCTTTGACAAAATCTACAGCACCAAGAGC GACGTGTGGTCTTACGGAGTATTGCTGTGGGA | SEQ ID NO: 277 |
| FLT4 | NM_002020.1 | ACCAAGAAGCTGAGGACCTGTGGCTGAGCCCGCTGACCATGGA AGATCTTGTCTGCTACAGCTTCCAGG | SEQ ID NO: 278 |
| FOS | NM_005252.2 | CGAGCCCTTTGATGACTTCTTGTTCCCAGCATCATCCAGGCCC AGTGGCTCTGAGACAGCCCGCTCC | SEQ ID NO: 279 |
| FOXO3A | NM_001455.1 | TGAAGTCCAGGACGATGATGCGCCTCTCTCGCCCATGCTCT ACAGCAGCTCAGCCAGCCTGTCACCTTCAGTAAGCAAGCCGT | SEQ ID NO: 280 |
| FPGS | NM_004957.3 | CAGCCCTGCCAGTTTGACTATGCCGTCTTCTGCCCTAACCTGA CAGAGGTGTCATCCACAGGCAAC | SEQ ID NO: 281 |
| FRP1 | NM_003012.2 | TTGGTACCTGTGGGTTAGCATCAAGTTCTCCCAGGGTAGAAT TCAATCAGAGCTCCAGTTTGCATTTGGATGTG | SEQ ID NO: 282 |
| FST | NM_006350.2 | GTAAGTCGGATGAGCCTGTCTGTGCCAGTGACAATGCCACTTAT GCCAGCGAGTGTGCCATGAAGGAAGCTG | SEQ ID NO: 283 |

TABLE B-continued

| Gene | Locus Link | Sequence | SEQ ID NO |
|---|---|---|---|
| Furin | NM_002569.1 | AAGTCCTCGATACGCACTATAGCACCGAGAATGACGTGGAG ACCATCCGGGCCAGCGTCTGCGCCCCCTGCCACGCCTCATG TGCCACATGCCAG | SEQ ID NO: 284 |
| FUS | NM_004960.1 | GGATAATTCAGACAACAACACCATCTTTGTGCAAGGCCTGGGT GAGAATGTTACAATTGAGTCTGTGGCTGATTACTTCA | SEQ ID NO: 285 |
| FUT1 | NM_000148.1 | CCGTGCTCATTGCTAACCACTGTCTGTCCCTGAACTCCCAG AACCACTACATCTGGCTTTGGGCAG | SEQ ID NO: 286 |
| FUT3 | NM_000149.1 | CAGTTCGGTCCAACAGAGAAAGCAGGCAACCACCATGTCAT TTGAAAACAGTTTCATCGGGATATAATTCGCA | SEQ ID NO: 287 |
| FUT6 | NM_000150.1 | CGTGTGTCTCAAGACGATCCCACTGTGTACCCTAATGGGTC CCGCTTCCCAGACAGCACAGGGACC | SEQ ID NO: 288 |
| FXYD5 | NM_014164.4 | AGAGCACCAAAGCAGCTCATCCCACTGATGACACCACGAC GCTCTCTGAGAGACCATCCCCAAGCAC | SEQ ID NO: 289 |
| FYN | NM_002037.3 | GAAGCGCAGATCATGAAGAAGCTGAAGCACGACAAGCTGGTC CAGCTCTATGCAGTGGTGTCTGAGGAG | SEQ ID NO: 290 |
| FZD1 | NM_003505.1 | GGTGCACCAGTTCTACCCTCTAGTGAAAGTGCAGTGTTCCGCT GAGCTCAAGTTCTTCCTGTGCTCCATGTACGC | SEQ ID NO: 291 |
| FZD2 | NM_001466.2 | TGGATCCTCACCTGGTCGGTGCTGTGCTGCGCTTCCACCTTCTT CACTGTCACCACGTACTTGGTAGACATGCAGCGC | SEQ ID NO: 292 |
| FZD6 | NM_003506.2 | AATGAGAGAGGTGAAAGCGGACGGAGCTAGCACCCCCAGGTTAA GAGAACAGGACTGTGGTGAACCT | SEQ ID NO: 293 |
| G-Catenin | NM_002230.1 | TCAGCAGCAAGGGCATCATGGAGGAGGATGAGGCCTGCG GGCGCCAGTACACGCTCAAGAAAACCACC | SEQ ID NO: 294 |
| G1P2 | NM_005101.1 | CAACGAATTCCAGGTGTCCCTGAGCAGCTCCATGTCGGTGTCA GAGCTGAAGGCGCAGATC | SEQ ID NO: 295 |
| GADD45 | NM_001924.2 | GTGCTGGTGACGAATCCACATTCATCTCAATGGAAGGATCC TGCCTTAAGTCAACTTATTTGTTTTTGCCGGG | SEQ ID NO: 296 |
| GADD45B | NM_015675.1 | ACCCTCGACAAGACCACACTTTGGGACTTGGGAGCTGGGG CTGAAGTTGCTCTGTACCCATGAACTCCCA | SEQ ID NO: 297 |
| GADD45G | NM_006705.2 | CGCGCTGCAGATCCATTTTACGCTGATCCAGGCTTTCTGCTG CGAGAACGACATCGACATAGTGCG | SEQ ID NO: 298 |
| GAGE4 | NM_001474.1 | GGAACAGGGTCACCCACAGACTGGGTGTGAGTGTGAAGATGGTC CTGATGGGCAGGAGATGGACCCGCCAAATC | SEQ ID NO: 299 |
| GBP1 | NM_002053.1 | TTGGGAAATATTTGGGCATTGGTCTGGCCAAGTCTACAATGTCC CAATATCAAGGACAACCACCCTAGCTTCT | SEQ ID NO: 300 |
| GBP2 | NM_004120.2 | GCATGGGAACCATCAACCAGCAGGCCATGGACCAACTTCACTAT GTGACAGAGCTGACAGATCGAATCAAGGCAAACTCCTCA | SEQ ID NO: 301 |
| GCLC | NM_001498.1 | CTGTTGCAGGAAGGCATTGATCATCTCCTGGCCCAGCATGTTGC TCATCTCTTTATTAGAGACCCACTGAC | SEQ ID NO: 302 |
| GCLM | NM_002061.1 | TGTAGAATCAAACTCTTCATCATCAACTAGAAGTGCAGTTGACA TGGCCTGTTCAGTCCTTGGAGTTGCACAGCTGGATTCTGTG | SEQ ID NO: 303 |
| GCNT1 | NM_001490.3 | TGGTGCTTGGAGCATAGAAGACTGCCCTTCACAAAGGAAATCC CTGATTATTGTTTGAAATGCTGAGGACGTTGC | SEQ ID NO: 304 |
| GDF15 | NM_004864.1 | CGCTCCAGACCTATGATGACTTGTTAGCCAAAGACTGCCACTG CATATGAGCAGTCCTGGTCCTTCCACTGT | SEQ ID NO: 305 |
| GIT1 | NM_014030.2 | GTGTATGACGAGGTGGATCGAAGAGAAAATGATGCAGTGTGGCTG GCTACCCAAAACCACAGCACTCTGGT | SEQ ID NO: 306 |
| GJA1 | NM_000165.2 | GTTCACTGGGGGTGTATGGGGTAGATGGGTGGAGAGGGAGGGGAT AAGAGAGGTGCATGTTGGTATTT | SEQ ID NO: 307 |
| GJB2 | NM_004004.3 | TGTCATGTACGACGGCTTCTCCATGCAGCGGCTGGTGAAGTGC AACGCCTGGCCTTGTCCCAACACTGTGGACT | SEQ ID NO: 308 |

TABLE B-continued

| Gene | Locus Link | Sequence | SEQ ID NO |
|---|---|---|---|
| GPX1 | NM_000581.2 | GCTTATGACCGACCCCAAGCTCATCACCTGGTCTCCGGTGTGT CGCAACGATGTTGCCTGGAACTTT | SEQ ID NO: 309 |
| GPX2 | NM_002083.1 | CACACAGATCTCCTACTCCATCCAGTCCTGAGGAGCCTTAGGA TGCAGCATGCCTTCAGGAGACACTGCTGGACC | SEQ ID NO: 310 |
| Grb10 | NM_005311.2 | CTTCGCCTTTGCTGATTGCCTCTCCAAACGCCTGCCTGACGA CTGCCTTGGAGCATGTGCGTTATGG | SEQ ID NO: 311 |
| GRB14 | NM_004490.1 | TCCCACTGAAGCCCTTTCAGTTGCGGTTGAAGAAGGACTCGC TTGGAGGAAAAAAGGATGTTTACGCCTGGGCACT | SEQ ID NO: 312 |
| GRB2 | NM_002086.2 | GTCCATCAGTGCATGACGTTTAAGGCCACGTATAGTCCTAGCT GACGCCAATAATAAAAAACAAGAAACCAAGTGGGCT | SEQ ID NO: 313 |
| GRB7 | NM_005310.1 | CCATCTGCATCCATCTTGTTTGGGCTCCCCACCCTTGAGAAGT GCCTCAGATAATACCCTGGTGGCC | SEQ ID NO: 314 |
| GRIK1 | NM_000830.2 | GTTGGGTGCATCTCTCGGGCGTCCGGCAGCGGCTGTATCTCG GCATGAATTAAGAAGCTAGGAAGATGGAGCACG | SEQ ID NO: 315 |
| GRO1 | NM_001511.1 | CGAAAAGATGCTGAACAGTGACAAATCCAACTGACCAGAAGG GAGGAGGAAGCTCACTGGTGGCTGTTCCTGA | SEQ ID NO: 316 |
| GRP | NM_002091.1 | CTGGGTCTCATAGAAGCAAAGGAGAACAGAAACCACCAGCCACC TCAACCCAAGGCCTTGGGCAATCAGCAGCCTTCGTGG | SEQ ID NO: 317 |
| GRPR | NM_005314.1 | ATGCTGCTGGCCATTCCAGAGGCCGTGTTTTCTGACCTCCATC CCTTCCATGAGGAAAGCACCAACCAGACCT | SEQ ID NO: 318 |
| GSK3B | NM_002093.2 | GACAAGGACGGCAGCAAGGTGACAACAGTGGTGGCAACTCCT GGGCAGGGTCCAGACAGGCCACAA | SEQ ID NO: 319 |
| GSTA3 | NM_000847.3 | TCTCCAACTTCCCTCTGCTGAAGGCCCTGAAAACCAGAATCA GCAACCTGCCCACGGTGAAGAAGT | SEQ ID NO: 320 |
| GSTM1 | NM_000561.1 | AAGCTATGAGGAAAAGAAGTACACGATGGGGGACGCTCCTGA TTATGACAGAAGCCAGTGGCTGAATGAAAAATTCAAGCTGGGCC | SEQ ID NO: 321 |
| GSTM3 | NM_000849.3 | CAATGCCATCTTGCGCTACATCGCTCGCAAGCACAACATGTG TGGTGAGACTGAAGAAGAAAAGATTCGAGTGGAC | SEQ ID NO: 322 |
| GSTp | NM_000852.2 | GAGACCCTGCTGTCCCAGAACCAGGGAGGCAAGACCTTCATTG TGGGAGACCAGATCTCCTTCGCTGACTACAACC | SEQ ID NO: 323 |
| GSTT1 | NM_000853.1 | CACCATCCCCACCCTGTCTTCCACAGCCGCCTGAAAGCCACA ATGAGAATGATGCACACTGAGGCC | SEQ ID NO: 324 |
| H2AFZ | NM_002106.2 | CCGGAAAGGCCAAGACAAAGGCGGTTTCCCGCTCGCAGAGAG CCGGCTTGCAGTTCCCAGTGGGCCGTATT | SEQ ID NO: 325 |
| HB-EGF | NM_001945.1 | GACTCCTTCGTCCCCAGTTGCCGTCTAGGATTGGGCCTCCCAT AATTGCTTTGCCAAAATACCAGAGCCTTCAAGTGCCA | SEQ ID NO: 326 |
| hCRA a | U78556.1 | TGACACCCTTACCTTCCTGAGAAATACCCCCTGGGAGCGCGGAA AGCAGAGCGGACAGGTCAGTGACTTCTATTTTTGACTCGTGTTTTT | SEQ ID NO: 327 |
| HDAC1 | NM_004964.2 | CAAGTACCACAGCGATGACTACATTAAATT CTTGCGCTCCATCCGTCCAGATAACATGTCGGAGTACAGCAAGC | SEQ ID NO: 328 |
| HDAC2 | NM_001527.1 | GGTGGCTACACAATCCGTAATGTTGCTCGATGTTGGA CATATGAGACTGCAGTTGCCCTTGATTGTGAGATTCCCA | SEQ ID NO: 329 |
| HDGF | NM_004494.1 | TCCTAGGCATTCTGGACCTCTGGGTTGGGATCAGGGGTA GGAATGGAAGGATGGAGCATCAACAGC | SEQ ID NO: 330 |
| hENT1 | NM_004955.1 | AGCCGTGACTGTTGAGGTCAAGTCCAGCATCGCAGGCA GCAGCACCTGGGAACGTTACTT | SEQ ID NO: 331 |
| Hepsin | NM_002151.1 | AGGCTGCTGGAGGTCATCTCCGTGTGTGATTGCCCCAGAG GCCGTTTCTTGGCCGCCATCTGCCAAGACTGTGGCCGCAGGAAG | SEQ ID NO: 332 |
| HER2 | NM_004448.1 | CGGTGTGAGAAGTGCAGCAAGCCCTGTGCCCGAGTGTGCTA TGGTCTGGGCATGGAGCACTTGCGAGAGG | SEQ ID NO: 333 |
| Herstatin | AF177761.2 | CACCCTGTCCTATCCTTCCTCAGACCCTCTTGGGACCTAGTCTCT GCCTTCTACTCTCTACCCCTGGCC | SEQ ID NO: 334 |

TABLE B-continued

| Gene | Locus Link | Sequence | SEQ ID NO |
|---|---|---|---|
| HES6 | NM_018645.3 | TTAGGGACCCTGCAGCTCTGGAGTGGGTGGAGGGAGGGAGC TACGGGCAGGAGGAAGAATTTTGTAG | SEQ ID NO: 335 |
| HGF | M29145.1 | CCGAAATCCAGATGATGATGCTCATGGACCCTGGTGCTACACGGGAA ATCCACTCATTCCTTGGG | SEQ ID NO: 336 |
| HIF1A | NM_001530.1 | TGAACATAAAGTCTGCAACATGGAAGGTATTGCACTGCACAGGCCA CATTCACGTATATGATACCAACAGTAACCAACCTCA | SEQ ID NO: 337 |
| HK1 | NM_000188.1 | TACGCACAGAGGCAAGCAGCTAAGAGTCCGGGATCCCCAGCCTAC TGCCTCTCCAGCACTTCTCTC | SEQ ID NO: 338 |
| HLA-DPB1 | NM_002121.4 | TCCATGATGGTTCTGCAGGTTTCTGCGGCCCCCCGGACAG TGGCTCTGACGGCGTTACTGATGGTGCTGCTCA | SEQ ID NO: 339 |
| HLA-DRA | NM_019111.3 | GACGATTTGCCAGCTTTGAGGCTCAAGGTGCATTGGCCAAC ATAGCTGTGGACAAAGCCAACCTGGA | SEQ ID NO: 340 |
| HLA-DRB1 | NM_002124.1 | GCTTTCTCAGGACCTGGTTGCTACTGGTTCGGCAACTGCAGAAAA TGTCCTCCCTTGTGGCTTCCT | SEQ ID NO: 341 |
| HLA-G | NM_002127.2 | CCTGCGCGGCTACTACAACCAGAGCGAGGCCAGTTCTCACACCCTCCA GTGGATGATTGGCTGCGACCTG | SEQ ID NO: 342 |
| HMGB1 | NM_002128.3 | TGGCCTGTCCATTGGTGATGTTGCGAAGAAACTGGGAGAGATGTGGAA TAACACTGCTGCAGATGACAAGC | SEQ ID NO: 343 |
| hMLH | NM_000249.2 | CTACTTCCAGCAACCCCAGAAAGAGACATCGGGAAGATTCTGA TGTGGAAATGGTGGAAGATGATTCCCGAAAG | SEQ ID NO: 344 |
| HNRPAB | NM_004499.2 | CAAGGGAGCGACCAACTGATCGCACACATGCTTTGTTTGGAT ATGGAGTGAACAATTATGTACCAAATTTAACTTGGCAAAC | SEQ ID NO: 345 |
| HNRPD | NM_031370.2 | GCCAGTAAGAACGAGGAGGATGAAGGCCATTCAAACTCCTCC CCACGACACTCTGAAGCAGCGACG | SEQ ID NO: 346 |
| HoxA1 | NM_005522.3 | AGTGACAGATGGACAATGCAAGAATGAACTCCTTCCTGGAAT ACCCCATACTTAGCAGTGGCGACTCGG | SEQ ID NO: 347 |
| HoxA5 | NM_019102.2 | TCCCTTGTGTTCCTTCTGTGAAGAAGCCCTGTTCTCGTTGCCCT AATTCATCTTTTAATCATGAGCCTGTTTATTGCC | SEQ ID NO: 348 |
| HOXB13 | NM_006361.2 | CGTGCCTTATGGTTACTTTGGAGGCGGGTACTACTCCTGCCGAG TGTCCCGGAGCTCGCTGAAACCCTGTG | SEQ ID NO: 349 |
| HOXB7 | NM_004502.2 | CAGCCTCAAGTTCGGTTTTCGCTACCGGAGCCTTCCCAGAACAAA CTTCTTGTGCGTTTGCTTCCAAC | SEQ ID NO: 350 |
| HRAS | NM_005343.2 | GGACGAATACGACCCCACTATAGAGGATTCCTACCGGAAGCAGGTG GTCATTGATGGGGAGACGTGC | SEQ ID NO: 351 |
| HSBP1 | NM_001537.1 | GGAGATGGCCGAGACTGACCCCAAGACCGTGCAGGACCTCACCTCG GTGGTGCAGACACTCCTGCAG | SEQ ID NO: 352 |
| HSD17B1 | NM_000413.1 | CTGGACCGCACGGACATCCACACCTTCCACCGCTTCTACCAATAC CTCGCCCACAGCAAGCAAGTCTTTCGCGAGGCG | SEQ ID NO: 353 |
| HSD17B2 | NM_002153.1 | GCTTTCCAAGTGGGGAATTAAAGTTGCTTCCATCCAACCTGGAGG CTTCCTAACAAATATCGCAGGCA | SEQ ID NO: 354 |
| HSPA1A | NM_005345.4 | CTGCTGCGACAGTCCACTACCTTTTTCGAGAGTGACTCCCGTTGTC CCAAGGCTTCCCAGAGCGAACCTG | SEQ ID NO: 355 |
| HSPA1B | NM_005346.3 | GGTCCGCTTCGTCTTTCGAGAGTGACTCCCGCGGTCCCAAGGCTT TCCAGAGCGAACCTGTGC | SEQ ID NO: 356 |
| HSPA4 | NM_002154.3 | TTCAGTGTGTCCAGTGCATCTTTAGTGGAGGTTCACAAGTCTGAGG AAAATGAGGAGCCAATGGAAACAGAT | SEQ ID NO: 357 |
| HSPA5 | NM_005347.2 | GGCTAGTAGAACTGGATCCCAACACCAAACTCTTAATTAGACCTAG GCCTCAGCTGCACTGCCCGAAAAGCATTTGGGCAGACC | SEQ ID NO: 358 |
| HSPA8 | NM_006597.3 | CCTCCCTCTGGTGGTGCTTCCTCAGGGCCCACCATTGAAGAGGTTG ATTAAGCCAACCAAGTGTAGATGTAGC | SEQ ID NO: 359 |
| HSPB1 | NM_001540.2 | CCGACTGGAGGAGCATAAAAGCGCAGCCGAGCCCAGCGCCCCGCA CTTTTCTGAGCAGACGTCCAGAGCAGAGTCAGCCAGCAT | SEQ ID NO: 360 |

TABLE B-continued

| Gene | Locus Link | Sequence | SEQ ID NO |
|---|---|---|---|
| HSPCA | NM_005348.2 | CAAAAGGCAGAGGCTGATAAGAACGACAAGTCTGTGAAGGATCT GGTCATCTTGCTTTATGAAACTGCGCT | SEQ ID NO: 361 |
| HSPE1 | NM_002157.1 | GCAAGCAACAGTAGTCGCTGTTGGATCGGGTTCTAAAGGAAAGG GTGGAGAGATTCAACCAGTTAGCGTGAAAGTTGG | SEQ ID NO: 362 |
| HSPG2 | NM_005529.2 | GAGTACGTGTGCCGAGTGTTGGGCAGCTCCGTGCCTCTAGAGG CCTCTGTCCTGGTCACCATTGAG | SEQ ID NO: 363 |
| ICAM1 | NM_000201.1 | GCAGACAGTGACCATCTACAGCTTTCCGGCGCCCAACGTGAT TCTGACGAAGCCAGAGGTCTCAGAAG | SEQ ID NO: 364 |
| ICAM2 | NM_000873.2 | GGTCATCCTGACACTGCAACCCACTTTGGTGGCTGTGGG CAAGTCCTTCACCATTGAGTGCA | SEQ ID NO: 365 |
| ID1 | NM_002165.1 | AGAACCGCAAGGTGAGCAAGGTGGAGATTCTCCAGCACGTC ATCGACTACATCAGGGACCTTCAGTTGGA | SEQ ID NO: 366 |
| ID2 | NM_002166.1 | AACGACTGCTACTCCAAGCTCAAGGAGCTGGTGCCCAGCAT CCCCCAGAACAAGAAGGTGAGCAAGATGGAAATCC | SEQ ID NO: 367 |
| ID3 | NM_002167.2 | CTTCACCAAATCCCTTCCTGGAGACTAAACCTGGTGCTCAG GAGCGAAGGACTGTGAACTTGTAGCCTGAAGAGCCAGAG | SEQ ID NO: 368 |
| ID4 | NM_001546.2 | TGGCCTGGCTCTTAATTTGCTTTTGTTTTGCCCAGTATAGAC TCGGAAGTAAGAGTTATAGCTAGTGGTCTTGCATGATTGCA | SEQ ID NO: 369 |
| IFIT1 | NM_001548.1 | TGACAACCAAGCAAATGTGAGGAGTCTGGTGACCTGGGGC AACTTTGCCTGGATGTATTACCACATGGGCAGACTG | SEQ ID NO: 370 |
| IGF1 | NM_000618.1 | TCCGGAGCTGTGATCTAAGGAGGCTGGAGATGTATTGCGCAC CCCTCAAGCCTGCCAAGTCAGCTCGCTCTGTCCG | SEQ ID NO: 371 |
| IGF1R | NM_000875.2 | GCATGGTAGCCGAAGATTTCACAGTCAAAATCGGAGATTTT GGTATGACGCGAGATATCTATGAGACAGACTATTACCGGAAA | SEQ ID NO: 372 |
| IGF2 | NM_000612.2 | CCGTGCTTCCGGACAACTTCCCCAGATACCCCGTGGGCAAGTT CTTCCAATATGACACCTGGAAGCAGTCCA | SEQ ID NO: 373 |
| IGFBP2 | NM_000597.1 | GTGGACAGCACCATGAACATGTTGGGCGGGGGAGGCAGTGC TGGCCGGAAGCCCCTCAAGTCGGGTATGAAGG | SEQ ID NO: 374 |
| IGFBP3 | NM_000598.1 | ACGCACCGGGTGTCTGATCCCAAGTTCCACCCCCTCCATTC AAAGATAATCATCATCAAGAAAGGGCA | SEQ ID NO: 375 |
| IGFBP5 | NM_000599.1 | TGGACAAGTACGGGATGAAGCTGCCAGGCATGGAGTACGT TGACGGGACTTTCAGTGCCACACCTTCG | SEQ ID NO: 376 |
| IGFBP6 | NM_002178.1 | TGAACCGCAGAGACCAACAGAGGAATCCAGGCACCTCTAC CACGCCCTCCCAGCCCAATTCTGCGGGTGTCCAAGAC | SEQ ID NO: 377 |
| IGFBP7 | NM_001553 | GGGTCACTATGGAGTTCAAAGGACAGAACTCCTGCCTGGTGA CCGGGACAACCTGGCCATTCAGACCC | SEQ ID NO: 378 |
| IHH | NM_002181.1 | AAGGACGAGGAGAACACAGGCGCCGACCGCCTCATGACCCAGC GCTGCAAGGACCGCCTGAACTCGCTGGCTATCT | SEQ ID NO: 379 |
| IL-8 | NM_000584.2 | AAGGAACCATCTCACTGTGTGTAAACATGACTTCCAAGCTGG CCGTGGCTCTCTTGGCAGCCTTCCTGAT | SEQ ID NO: 380 |
| IL10 | NM_000572.1 | GGCGCTGTCATCGATTTCTTCCCTGTGAAAACAAGAGCAAGGC CGTGGAGCAGGTGAAGAATGCCTTTAATAAGCTCCA | SEQ ID NO: 381 |
| IL1B | NM_000576.2 | AGCTGAGGAAGATGCTGGTTCCCTGCCCACAGACCTTCCAG GAGAATGACCTGAGCACCTTCTTTCC | SEQ ID NO: 382 |
| IL6 | NM_000600.1 | CCTGAACCTTCCAAAGATGGCTGAAAAAGATGGATGCTTCCA ATCTGGATTCAATGAGGAGACTTGCCTGGT | SEQ ID NO: 383 |
| IL6ST | NM_002184.2 | GGCCTAATGTTCCAGATCCTTCAAAGAGTCATATTGCCCA GTGGTCACCTCACACTCCTCCAAGGCACAATTTT | SEQ ID NO: 384 |
| ILT-2 | NM_006669.1 | AGCCATCACTCTCAGTGCAGCCAGGTCCTATCGTGGCCCC TGAGGAGACCCTGACTCTGCAGT | SEQ ID NO: 385 |
| IMP-1 | NM_006546.2 | GAAAGTGTTTGCGGAGCACAAGATCTCCTACAGCGGCCA GTTCTTGGTCAAATCCGGCTACGCCTTC | SEQ ID NO: 386 |

TABLE B-continued

| Gene | Locus Link | Sequence | SEQ ID NO |
|---|---|---|---|
| IMP2 | NM_006548.3 | CAATCTGATCCCAGGGTTGAACCTCAGCGCACTTGGCATCTT TTCAACAGGACTGTCCGTGCTATCTCCACCAGCAGGGCC | SEQ ID NO: 387 |
| ING1L | NM_001564.1 | TGTTTCCAAGATCCTGCTGAAAGTGAACAGAGCCTCAGATAAA GCAAAGATGGATTCCAGCCAACCAGAAAGA | SEQ ID NO: 388 |
| ING5 | NM_032329.4 | CCTACAGCAAGTGCAAGGAATACAGTGACGACAAAGTGCAGCT GGCCATGCAGACCTACGAGATG | SEQ ID NO: 389 |
| INHA | NM_002191.2 | CCTCCCAGTTTCATCTTCCACTACTGTCATGGTGGTTGTGGGC TGCAGATCCCACCAAACCTGTCCCTTCCAGTCCCT | SEQ ID NO: 390 |
| INHBA | NM_002192.1 | GTGCCCGAGCCATATAGCAGGCACGTCCGGGTCCTCACTGTC CTTCCACTCAACAGTCATCAACCACTACCG | SEQ ID NO: 391 |
| INHBB | NM_002193.1 | AGCCTCCAGGATACCAGCAAATGGATGCGGTGACAAATGGCA GCTTAGCTACAAATGCCTGTCAGTCGGAGA | SEQ ID NO: 392 |
| IRS1 | NM_005544.1 | CCACAGCTCACCTTCTGTCAGGTGTCCATCCCAGCTCCAGCCAG CTCCCAGAGAGGAAGAGACTGGCACTGAGG | SEQ ID NO: 393 |
| ITGA3 | NM_002204.1 | CCATGATCCTCACTCTGCTGGTGGACTATACACTCCAGACCTC GCTTAGCATGGTAAATCACCGGCTACAAAGCTTC | SEQ ID NO: 394 |
| ITGA4 | NM_000885.2 | CAACGCTTCAGTGATCAATCCCGGGGCGATTTACAGATGCAGG ATCGGAAAGAATCCCGGCCAGAC | SEQ ID NO: 395 |
| ITGA5 | NM_002205.1 | AGGCCAGCCCACATTATCAGAGCAAGAGCCGGATAGAGGACA AGGCTCAGATCTTGCTGGACTGTGGAGAAGAC | SEQ ID NO: 396 |
| ITGA6 | NM_000210.1 | CAGTGACAAACAGCCCTTCCAACCCAAGGAATCCCACAAAAG ATGGCGATGACGCCCATGAGGCTAAAC | SEQ ID NO: 397 |
| ITGA7 | NM_002206.1 | GATATGATTGGTCGCTGCTTTGTGCTCAGCCAGGACCTGGCC ATCCGGGATGAGTTGGATGGTGGGGAATGGAAGTTCT | SEQ ID NO: 398 |
| ITGAV | NM_002210.2 | ACTCGGACTGCACAAGCTATTTTTGATGACAGCTATTTGGGT TATTCTGTGGCTGTCGGAGATTTCAATGGTGATGGCA | SEQ ID NO: 399 |
| ITGB1 | NM_002211.2 | TCAGAATTGGATTTGGCTCATTTGTGGAAAAGACTGTGATGC CTTACATTAGCACAACACCAGCTAAGCTCAGG | SEQ ID NO: 400 |
| ITGB3 | NM_000212.1 | ACCGGGAGCCCTACATGACCGAAAATACCTGCAACCGTTACT GCCGTGACGAGATTGAGTCAGTGAAAGAGCTTAAGG | SEQ ID NO: 401 |
| ITGB4 | NM_000213.2 | CAAGGTGCCCTCAGTGGAGCTCACCAACCTGTACCCGTATTG CGACTATGAGATGAAGGTGTGCGC | SEQ ID NO: 402 |
| ITGB5 | NM_002213.3 | TCGTGAAAGATGACCAGGAGGCTGTGCTATGTTTCTACAAAA CCGCCAAGGACTGCGTCATGATGTTCACC | SEQ ID NO: 403 |
| K-ras | NM_033360.2 | GTCAAATGGGGAGGGACTAGGGCAGTTTGGATAGCTCAACA AGATACAATCTCACTCTGTGGTGGTCCTG | SEQ ID NO: 404 |
| KCNH2 iso a/b | NM_000238.2 | GAGCGCAAAGTGGAAATCGCCTTCTACCGGAAAGATGG GAGCTGCTTCCTATGTCTGGTGGATGTGGTGCCCGTGAAGA | SEQ ID NO: 405 |
| KCNH2 iso a/c | NM_172057.1 | TCCTGCTGCTGGTCATCTACACGGCTGTCTTCACACCC TACTCGGCTGCCTTCCTGCTGAAGGAGACGGAAGAAGG | SEQ ID NO: 406 |
| KCNK4 | NM_016611.2 | CCTATCAGCCGCTGGTGTGGTTCTGGATCCTGCTCGGCCTGG CTTACTTCGCCTCAGTGCTCACCACCA | SEQ ID NO: 407 |
| KDR | NM_002253.1 | GAGGACGAAGGCCTCTACACCTGCCAGGCATGCAGTGTTCTTGG CTGTGCAAAAGTGGAGGCATTTTT | SEQ ID NO: 408 |
| Ki-67 | NM_002417.1 | CGGACTTTGGGTGCGACTTGACGAGCGGTGGTTCGACAAGT GGCCTTGCGGGCCGGATCGTCCCAGTGGAAGAGTTGTAA | SEQ ID NO: 409 |
| KIAA0125 | NM_014792.2 | GTGTCCTGGTCCATGTGGTGCACGTGTCTCCACCTCC AAGGAGAGGCTCCTCAGTGTGCACCTCCC | SEQ ID NO: 410 |
| KIF22 | NM_007317.1 | CTAAGGCACTTGCTGGAAGGGCAGAATGCCAGTGTGCTTG CCTATGGACCCACAGGAGCTGGGAAGA | SEQ ID NO: 411 |
| KIF2C | NM_006845.2 | AATTCCTGCTCCAAAAGAAAGTCTTCGAAGCCGCTCCAC TCGCATGTCCACTGTCTCAGAGCTTCGCATCACG | SEQ ID NO: 412 |

TABLE B-continued

| Gene | Locus Link | Sequence | SEQ ID NO |
|---|---|---|---|
| KIFC1 | XM_371813.1 | CCACAGGGTTGAAGAACCAGAAGCCAGTTCCTGCTGTTC CTGTCCAGAAGTCTGGCACATCAGGTG | SEQ ID NO: 413 |
| Kitlng | NM_000899.1 | GTCCCCGGGATGGATGTTTTGCCAAGTCATTGTTGGAT AAGCGAGATGGTAGTACAATTGTCAGACAGCTTGACTGATC | SEQ ID NO: 414 |
| KLF5 | NM_001730.3 | GTGCAACCGCAGCTTCTCGCGCTCTGACCACCTGGCCCTG CATATGAAGAGGCACCAGAACTGAGCACTGCCCG | SEQ ID NO: 415 |
| KLF6 | NM_001300.4 | CACGAGACCGGCTACTTCTCGGCGCTGCCGTCTCTGGAGG AGTACTGGCAACAGACCTGCCTAGAGC | SEQ ID NO: 416 |
| KLK10 | NM_002776.1 | GCCCAGAGGCTCCATCGTCCATCCTCTTCCTCCCCAGTC GGCTGAACTCTCCCCTTGTCTGCACTGTTCAAACCTCTG | SEQ ID NO: 417 |
| KLK6 | NM_002774.2 | GACGTGAGGGTCCTGATTCTCCCTGGTTTTACCCCAGCTCC ATCCTTGCATCACTGGGGAGGACGTGATGAGTGAGGA | SEQ ID NO: 418 |
| KLRK1 | NM_007360.1 | TGAGAGCCAGGCTTCTTGTATGTCTCAAAATGCCAGCCTTC TGAAAGTATACAGCAAAGAGGACCAGGAT | SEQ ID NO: 419 |
| KNTC2 | NM_006101.1 | ATGTGCCAGTGAGCTTGAGTCCTTGGAGAAACACAAGCACCT GCTAGAAAGTACTGTTAACCAGGGGCTCA | SEQ ID NO: 420 |
| KRAS2 | NM_004985.3 | GAGACCAAGGTTGCAAGGCCAGGCCCTGTGTGAACCTTTGAG CTTTCATAGAGTTTCACAGCATGGACTG | SEQ ID NO: 421 |
| KRT19 | NM_002276.1 | TGAGCGGCAGAATCAGGAGTACCAGCGGCTCATGGACATCAA GTCGCGGCTGGAGCAGGAGATTGCCACCTACCGCA | SEQ ID NO: 422 |
| KRT8 | NM_002273.1 | GGATGAAGCTTACATGAACAAGGTAGAGCTGGAGTCTCGCCTG GAAGGGCTGACCGACGAGATCAACTTCCTCAGGCAGCTATATG | SEQ ID NO: 423 |
| LAMA3 | NM_000227.2 | CAGATGAGGCACATGGAGACCCAGGCCAAGGACCTGAGGAAT CAGTTGCTCAACTACCGTTCTGCCATTTCAA | SEQ ID NO: 424 |
| LAMB3 | NM_000228.1 | ACTGACCAAGCCTGAGACCTACTGCACCCAGTATGGCGAGTG GCAGATGAAATGCTGCAAGTGTGAC | SEQ ID NO: 425 |
| LAMC2 | NM_005562.1 | ACTCAAGCGGAAATTGAAGCAGATAGGTCTTATCAGCACAGT CTCCGCCTCCTGGATTCAGTGTCTCGGCTTCAGGGAGT | SEQ ID NO: 426 |
| LAT | NM_014387.2 | GTGAACGTTCCGGAGAGCGGGGAGAGCGCAGAAGCGTCTCTGG ATGGCAGCCGGGAGTATGTGAATGT | SEQ ID NO: 427 |
| LCN2 | NM_005564.2 | CGCTGGGCAACATTAAGAGTTACCCTGGATTAACGAGTTACC TCGTCCGAGTGGTGAGCACCAACTACAACCAGCATGCT | SEQ ID NO: 428 |
| LDLRAP1 | NM_015627.1 | CAGTGCCTCTCGCCTGTCGACTGGGACAAGCCTGACAGC AGCGGCACAGAGCAGGATGACCTCTTCA | SEQ ID NO: 429 |
| LEF | NM_016269.2 | GATGACGGAAAGCATCCAGATGGAGGCCTCTACAACAAGGG ACCCTCCTACTCGAGTTATTCCGGG | SEQ ID NO: 430 |
| LGALS3 | NM_002306.1 | AGCGGAAAATGGCAGACAATTTTTCGCTCCATGATGCG TTATCTGGGTCTGGAAACCCAAACCCTCAAG | SEQ ID NO: 431 |
| LGMN | NM_001008530.1 | TTGGTGCCGTTCCTATAGATGATCCTGAAGATGGAG GCAAGCACTGGGTGGTGATCGTGGCAGGTTC | SEQ ID NO: 432 |
| LILRB3 | NM_006864.1 | CACCTGGTCTGGGAAGATACCTGGAGGTTTTGATTGG GGTCTCGGTGGCCTTCGTCCTGCTGCTCTT | SEQ ID NO: 433 |
| LMNB1 | NM_005573.1 | TGCAAACGCTGGTGTCACAGCCAGCCCCCCAACTGACC TCATCTGGAAGAACCAGAACTCGTGGGG | SEQ ID NO: 434 |
| LMYC | NM_012421.1 | CCCATCCAGAACACTGATTGCTGTCATTCAAGTGAAAG GGATGGAGGTCAGAAAGGGTGCATAGAAAGCAG | SEQ ID NO: 435 |
| LOX | NM_002317.3 | CCAATGGGAGAACAACGGGCAGGTGTTCAGCTTGCTGAG CCTGGGCTCACAGTACCAGCCTCAGCG | SEQ ID NO: 436 |
| LOXL2 | NM_002318.1 | TCAGCGGGCTCTTAAACAACCAGCTGTCCCCGCAGT AAAGAAGCCTGCGTGGTCAACTCCTGTCTT | SEQ ID NO: 437 |
| LRP5 | NM_002335.1 | CGACTATGACCCACTGGACAAGTTCATCTACTGGGTG GATGGGCGCCAGAACATCAAGCGAGCCAAG | SEQ ID NO: 438 |

TABLE B-continued

| Gene | Locus Link | Sequence | SEQ ID NO |
|---|---|---|---|
| LRP6 | NM_002336.1 | GGATGTAGCCATCTCTGCCTCTATAGACCTCAGGGCC TTCGCTGTGCTTGCCCTATTGGCTTTGAACT | SEQ ID NO: 439 |
| LY6D | NM_003695.2 | AATGCTGATGACTTGGAGCAGGCCCCACAGACCCCA CAGAGGATGAAGCCACCCCACAGAGGATGCAG | SEQ ID NO: 440 |
| MAD | NM_002357.1 | TGGTTCTGATTAGGTAACGTATTGGACCTGCCCACAA CTCCCTTGCACGTAAACTTCAGTGTCCCACCTTGACC | SEQ ID NO: 441 |
| MAD1L1 | NM_003550.1 | AGAAGCTGTCCCTGCAAGAGCAGGATGCAGCGATT GTGAAGAACATGAAGTCTGAGCTGGTACGGCT | SEQ ID NO: 442 |
| MAD2L1 | NM_002358.2 | CCGGGAGCAGGGAATCACCCTGCGCGGGAGCGCCGAAAT CGTGGCCGAGTTCTTCTCATTCGGCATCAACAGCAT | SEQ ID NO: 443 |
| MADH2 | NM_005901.2 | GCTGCCTTTGGTAAGAACATGTCGTCCATCTTGCCATTCAC GCCGCCAGTTGTGAAGAGACTGCTGGGAT | SEQ ID NO: 444 |
| MADH4 | NM_005359.3 | GGACATTACTGGCCTGTTCACAATGAGCTTGCATTCCAGCC TCCCATTTCCAATCATCCTGCTCCTGAGTATTGGT | SEQ ID NO: 445 |
| MADH7 | NM_005904.1 | TCCATCAAGGCTTTCGACTACGAGAAGGCGTACAGCCTGCA GCGGCCCAATGACCACGAGTTTATGCAGCAG | SEQ ID NO: 446 |
| MAP2 | NM_031846.1 | CGGACCACCAGGTCAGAGCCAATTCGCAGAGCAGGGAAGAGTG GTACCTCAACACCCACTACCCCTG | SEQ ID NO: 447 |
| MAP2K1 | NM_002755.2 | GCCTTTCTTACCCAGAAGCAGAAGGTGGGAGAACTGAAGGAT GACGACTTTGAGAAGATCAGTGAGCTGGGGCTG | SEQ ID NO: 448 |
| MAP3K1 | XM_042066.8 | GGTTGGCATCAAAAGGAACTGGTGCAGGAGAGTTTCAGGGAC AATTACTGGGGACAATTGCATTTATGGCA | SEQ ID NO: 449 |
| MAPK14 | NM_139012.1 | TGAGTGGAAAAGCCTGACCTATGATGAAGTCATCAGCTTTGT GCCACCACCCCTTGACCAAGAAGAGATGGAGTCC | SEQ ID NO: 450 |
| Maspin | NM_002639.1 | CAGATGGCCACTTTGAGAACATTTTAGCTGACAACAGTGTGA ACGACCAGACCAAAATCCTTGTGGTTAATGCTGCC | SEQ ID NO: 451 |
| MAX | NM_002382.3 | CAAACGGGCTCATCATAATGCACTGGAACGAAAACGTAGGGACCA CATCAAAGACAGCTTTCACAGTTTGCGGGA | SEQ ID NO: 452 |
| MCM2 | NM_004526.1 | GACTTTTGCCCGCTACCTTTCATTCCGGCGTGACAACAATGAGC TGTTGCTCTTCATACTGAAGCAGTTAGTGGC | SEQ ID NO: 453 |
| MCM3 | NM_002388.2 | GGAGAACAATCCCCTTGAGACAGAATATGGCCTTTCTGTCTACA AGGATCACCAGACCATCACCATCCAGGAGAT | SEQ ID NO: 454 |
| MCM6 | NM_005915.2 | TGATGGTCCTATGTGTCACATTCATCACAGGTTTCATACCAACA CAGGCTTCAGCACTTCCTTTGGTGTGTTTCCTGTCCCA | SEQ ID NO: 455 |
| MCP1 | NM_002982.1 | CGCTCAGCCAGATGCAATCAATGCCCCAGTCACCTGCTGTTATA ACTTCACCAATAGGAAGATCTCAGTGC | SEQ ID NO: 456 |
| MDK | NM_002391.2 | GGAGCCGACTGCAAGTACAAGTTTGAGAACTGGGGTGCGTGTGA TGGGGGCACAGGCACCAAAGTC | SEQ ID NO: 457 |
| MDM2 | NM_002392.1 | CTACAGGGACGCCATCGAATCCGGATCTTGATGCTGGTGTAAG TGAACATTCAGGTGATTGGTGGAT | SEQ ID NO: 458 |
| MGAT5 | NM_002410.2 | GGAGTCGAAGGTGGACAATCTTGTTGTCAATGGCACCGGAAC AAACTCAACCAACTCCACTACAGCTGTTCCCA | SEQ ID NO: 459 |
| MGMT | NM_002412.1 | GTGAAATGAAACGCACCACACTGGACAGCCCTTTGGGAAGCT GGAGCTGTCTGGTTGTGAGCAGGGTC | SEQ ID NO: 460 |
| mGST1 | NM_020300.2 | ACGGATCTACCACACCATTGCATATTTGACACCCCTTCCCCAG CCAAATAGAGCTTTGAGTTTTTTTGTTGGATATGGA | SEQ ID NO: 461 |
| MMP1 | NM_002421.2 | GGGAGATCATCGGGACAACTCTCCTTTTGATGGACCTGGAGGAA ATCTTGCTCATGCTTTTCAACCAGGCCC | SEQ ID NO: 462 |
| MMP12 | NM_002426.1 | CCAACGCTTGCCAAATCCTGACAATTCAGAACCAGCTCTCTGT GACCCCAATTTGAGTTTTGATGCTGTCACTACCGT | SEQ ID NO: 463 |
| MMP2 | NM_004530.1 | CCATGATGGAGAGGCAGACATCATGATCAACTTTGGCCGCTGGG AGCATGGCGATGGATACCCCTTTGACGGTAAGGACGGACTCC | SEQ ID NO: 464 |

TABLE B-continued

| Gene | Locus Link | Sequence | SEQ ID NO |
|---|---|---|---|
| MMP7 | NM_002423.2 | GGATGGTAGCAGTCTAGGGATTAACTTCCTGTATGCTGCAACTC ATGAACTTGGCCATTCTTTGGGTATGGGACATTCC | SEQ ID NO: 465 |
| MMP9 | NM_004994.1 | GAGAACCAATCTCACCGACAGGCAGCTGGCAGAGGAATACCTGT ACCGCTATGGTTACACTCGGGTG | SEQ ID NO: 466 |
| MRP1 | NM_004996.2 | TCATGGTGCCCGTCAATGCTGTGATGGCGATGAAGACCAAGACG TATCAGGTGGCCCACATGAAGAGCAAAGACAATCG | SEQ ID NO: 467 |
| MRP2 | NM_000392.1 | AGGGGATGACTTGGACACATCTGCCATTCGACATGACTGCAATT TTGACAAAGCCATGCAGTTTT | SEQ ID NO: 468 |
| MRP3 | NM_003786.2 | TCATCCTGGCGATCTACTTCCTCTGGCAGAACCTAGGTCCCTCT GTCCTGGCTGGAGTCGCTTTCATGGTCTTGCTGATTCCACTCAACGG | SEQ ID NO: 469 |
| MRP4 | NM_005845.1 | AGCGCCTGGAATCTACAACTCGGAGTCCAGTGTTTTCCCACTTG TCATCTTCTCTCCAGGGGCTCT | SEQ ID NO: 470 |
| MRPL40 | NM_003776.2 | ACTTGCAGGCTGCTATCCTTAACATGCTGCCCCTGAGAGTA GGAATGACCAGGGTTCAAGTCTGCT | SEQ ID NO: 471 |
| MSH2 | NM_000251.1 | GATGCAGAATTGAGGCAGACTTTACAAGAAGATTTACTTCGTC GATTCCCAGATCTTAACCGACTTGCCAAGA | SEQ ID NO: 472 |
| MSH3 | NM_002439.1 | TGATTACCATCATGGCTCAGATTGGCTCCTATGTTCCTGCAGA AGAAGCGACAATTGGGATTGTGGATGGCATTTTCACAAG | SEQ ID NO: 473 |
| MSH6 | NM_000179.1 | TCTATTGGGGATTGGTAGGAACCGTTACCAGCTGGAAATTCC TGAGAATTTCACCACTCGCAATTTG | SEQ ID NO: 474 |
| MT3 | NM_005954.1 | GTGTGAGAAGTGTGCCAAGGACTGTGTGTGCAAAGGCGGAGAGG CAGCTGAGGCAGAAGCAGAGAAGTGCAG | SEQ ID NO: 475 |
| MTA1 | NM_004689.2 | CCGCCCTCACCTGAAGAGAAACGCGCTCCTTGGCGGACACTGG GGGAGGAGAGGAAGAAGCGCGGCTAACTTATTCC | SEQ ID NO: 476 |
| MUC1 | NM_002456.1 | GGCCAGGATCTGTGGTGGTACAATTGACTCTGGCCTTCCGAGAAG GTACCATCAATGTCCACGACGTGGAG | SEQ ID NO: 477 |
| MUC2 | NM_002457.1 | CTATGAGCCATGTGGGAACCGGAGCTTCGAGACCTGCAGGACCAT CAACGGCATCCACTCCAACAT | SEQ ID NO: 478 |
| MUC5B | XM_039877.11 | TGCCCTTGCACTGTCCTAACGGCTCAGCCATCCTGCACACCTA CACCCACGTGGATGAGTGTGGCTG | SEQ ID NO: 479 |
| MUTYH | NM_012222.1 | GTACGACCAAGAGAAACGGGACCTACCATGGAGAAGACGGGCAG AAGATGAGATGGACCTGGACAGG | SEQ ID NO: 480 |
| MVP | NM_017458.1 | ACGAGAACGAGGGCATCTATGTGCAGGATGTCAAGACCGGAAAGGT GCGCGCTGTGATTGGAAGCACCTACATGC | SEQ ID NO: 481 |
| MX1 | NM_002462.2 | GAAGGAATGGGAATCAGTCATGAGCTAATCACCCTGGAGATCAGCT CCCGAGATGTCCCGGATCTGACTCTAATAGAC | SEQ ID NO: 482 |
| MXD4 | NM_006454.2 | AGAAACTGGAGGAGCAGGACCGCCGGGCACTGAGCATCAAGGAGC AGCTGCAGCAGGAGCATCGTTTCCTGAAG | SEQ ID NO: 483 |
| MYBL2 | NM_002466.1 | GCCAGAGATCGCCAAGATGTTGCCAGGGAGGACAGACAATGCTGT GAAGAATCACTGGAACTCTACCATCAAAAG | SEQ ID NO: 484 |
| MYH11 | NM_002474.1 | CGGTACTTCTGAGGGCTAATATATACGTACTCTGGCCTCTTCTG CGTGGTGGTCAACCCCTATAAACACCTGCCCATCTACTCGG | SEQ ID NO: 485 |
| MYLK | NM_053025.1 | TGACGGAGCGTGAGTGCATCAAGTACATGCGGCAGATCTCGGAGG GAGTGGAGTACATCCACAAGCAGGGCAT | SEQ ID NO: 486 |
| NAT2 | NM_000015.1 | TAACTGACATTCTTGAGCACCAGATCCGGGCTGTTCCCTTTGAGA ACCTTAACATGCATTGTGGGCAAGCCAT | SEQ ID NO: 487 |
| NAV2 | NM_182964.3 | CTCTCCCAGCACAGCTTGAACCTCACTGAGTCAACCAGCCTGGAC ATGTTGCTGGATGACACTGGTG | SEQ ID NO: 488 |
| NCAM1 | NM_000615.1 | TAGTTCCCAGCTGACCATCAAAAAGGTGGATAAGAACGACGAG GCTGAGTACATCTGCATTGCTGAGAACAAGGCTG | SEQ ID NO: 489 |
| NDE1 | NM_017668.1 | CTACTGCGGAAAGTCGGGGCACTGGAGTCCAAACTCGCTTCCTGC CGGAACCTCGTGTACGATCAGTCC | SEQ ID NO: 490 |

TABLE B-continued

| Gene | Locus Link | Sequence | SEQ ID NO |
|---|---|---|---|
| NDRG1 | NM_006096.2 | AGGGCAACATTCCACAGCTGCCCTGGCTGTGATGAGTGTCCTT GCAGGGGCCGGAGTAGGAGCACTG | SEQ ID NO: 491 |
| NDUFS3 | NM_004551.1 | TATCCATCCTGATGGCGTCATCCCAGTGCTGACTTTCCTCAG GGATCACACCAATGCACAGTTCAA | SEQ ID NO: 492 |
| NEDD8 | NM_006156.1 | TGCTGGCTACTGGGTGTTAGTTTGCAGTCCTGTGTGCTTCCCT CTCTTATGACTGTGTCCCTGGTTGTC | SEQ ID NO: 493 |
| NEK2 | NM_002497.1 | GTGAGGCAGCGCGACTCTGGCGACTGGCCGGCCATGCCTTCCCG GGCTGAGGACTATGAAGTGTTGTACACCATTGGCA | SEQ ID NO: 494 |
| NF2 | NM_000268.2 | ACTCCAGAGCTGACCTCCACCGCCCAGCCTGGGAAGTCATTGTAG GGAGTGAGACACTGAAGCCCTGA | SEQ ID NO: 495 |
| NFKBp50 | NM_003998.1 | CAGACCAAGGAGATGGACCTCAGCGTGGTGCGGCTCATGTTT ACAGCTTTTCTTCCGGATAGCACTGGCAGCT | SEQ ID NO: 496 |
| NFKBp65 | NM_021975.1 | CTGCCGGGATGGCTTCTATGAGGCTGAGCTCTGCCCGGACCGC TGCATCCACAGTTTCCAGAACCTGG | SEQ ID NO: 497 |
| NISCH | NM_007184.1 | CCAAGGAATCATGTTCGTTCAGGAGGAGGCCCTGGCCAGCAGCCTC TCGTCCACTGACAGTCTGACTCCCGAGCACCA | SEQ ID NO: 498 |
| Nkd-1 | NM_033119.3 | GAGAGAGTGAGCGAACCCTGCCCAGGCTCCAAGAAGCAGCTGAAG TTTGAAGAGCTCCAGTGCGACG | SEQ ID NO: 499 |
| NMB | NM_021077.1 | GGCTGCTGGTACAAATACTGCAGAAATGACACCAATAATAGGGGCA GACACAACAGCGTGGCTTAGATTG | SEQ ID NO: 500 |
| NMBR | NM_002511.1 | TGATCCATCTCTAGGCCACATGATTGTCACCTTAGTTGCCCGGGT TCTCAGTTTTGGCAATTCTTGTGTCAACCCATTTGCTC | SEQ ID NO: 501 |
| NME1 | NM_000269.1 | CCAACCCTGCAGACTCCAAGCCTGGGACCATCCGTGGAGACTTC TGCATACAAGTTGGCAGGAACATTATACAT | SEQ ID NO: 502 |
| NOS3 | NM_000603.2 | ATCTCCGCCTCGCTCATGGGCACGGTGATGGCGAAGCGAGTGA AGGCGACAATCCTGTATGGCTCCGA | SEQ ID NO: 503 |
| NOTCH1 | NM_017617.2 | CGGGTCCACCAGTTTGAATGGTCAATGCGAGTGGCTGTCC CGGCTGCAGAGCGGCATGGTGCCGAACCAATACAAC | SEQ ID NO: 504 |
| NOTCH2 | NM_024408.2 | CACTTCCCTGCTGGGATTATATCAACAACCAGTGTGATGA GCTGTGCAACACGGTCGAGTGCCTGTTTGACAACT | SEQ ID NO: 505 |
| NPM1 | NM_002520.2 | AATGTTGTCCAGGTTCTATTGCCAAGAATGTGTTGTCCAAAA TGCCTGTTTAGTTTTTAAAGATGGAACTCCACCCTTTGCTTG | SEQ ID NO: 506 |
| NR4A1 | NM_002135.2 | CACAGCTTGCTTGTCGATGTCCCTGCCTTCGCCTGCCTCTC TGCCCTTGTCCTCATCACCGACCGGCAT | SEQ ID NO: 507 |
| NRG1 | NM_013957.1 | CGAGACTCTCCTCATAGTGAAAGGTATGTGTCAGCCATGACC ACCCCGGCTCGTATGTCACCTGTAGATTTCCACACGCCAAG | SEQ ID NO: 508 |
| NRP1 | NM_003873.1 | CAGCTCTCTCCACGCGATTCATCAGGATCTACCCCGAGAGAGC CACTCATGGCGGACTGGGGCTCAGAATGGAGCTGCTGGG | SEQ ID NO: 509 |
| NRP2 | NM_003872.1 | CTACAGCCTAAACGGCAAGGACTGGGAATACATTCAGGACCCC AGGACCCAGCAGCCAAAGCTGTTCGAAGGGAAC | SEQ ID NO: 510 |
| NTN1 | NM_004822.1 | AGAAGGACTATGCCGTCCAGATCCACATCCTGAAGGCGGACAA GGCGGGGACTGGTGGAAGTTCACGG | SEQ ID NO: 511 |
| NUFIP1 | NM_012345.1 | GCTTCCACATCGTGGTATTGGAGACAGTCTTCTGATAGGTT TCCTCGGCATCAGAAGTCCTTCAACCCTGCAGTT | SEQ ID NO: 512 |
| ODC1 | NM_002539.1 | AGAGATCACCGGCGTAATCAACCCAGCGTTGGACAAATACTTT CCGTCAGACTCTGGAGTGAGAATCATAGCTGAGCCCG | SEQ ID NO: 513 |
| OPN, osteopontin | NM_000582.1 | CAACCGAAGTTTTCACTCCAGTTGTCCCCACAGTAGACACATA TGATGGCCGAGGTGATAGTGTGGTTTATGGACTGAGG | SEQ ID NO: 514 |
| ORC1L | NM_004153.2 | TCCTTGACCATACCGGAGGGTGCATGTACATCTCCGGTGTCC CTGGGACAGGGAAGACTGCCACTG | SEQ ID NO: 515 |
| OSM | NM_020530.3 | GTTTCTGAAGGGGAGGTCACAGCCTGAGCTGGCCTCCTATGCCT CATCATGTCCCAAACCAGACACCT | SEQ ID NO: 516 |

TABLE B-continued

| Gene | Locus Link | Sequence | SEQ ID NO |
|---|---|---|---|
| OSMR | NM_003999.1 | GCTCATCATGGTCATGTGCTACTTGAAAAGTCAGTGGATCAAGG AGACCTGTTATCCTGACATCCCTGACCCTTACA | SEQ ID NO: 517 |
| P14ARF | S78535.1 | CCCTCGTGCTGATGCTACTGAGGAGCCAGCGTCTAGGGCAGCAGCC GCTTCCTAGAAGACCAGGTCATGATG | SEQ ID NO: 518 |
| p16-INK4 | L27211.1 | GCGGAAGGTCCCTCAGACATCCCCGATTGAAAGAACCAGAGAG GCTCTGAGAAACCTCGGGAACTTAGATCATCA | SEQ ID NO: 519 |
| p21 | NM_000389.1 | TGGAGACTCTCAGGGTCGAAAACGGCGGCAGACCAGCATGACAGAT TTCTACCACTCCAAACGCC | SEQ ID NO: 520 |
| p27 | NM_004064.1 | CGGTGGACCACGAAGAGTTAACCCGGGACTTGGAGAAG CACTGCAGAGACATGGAAGAGGCGAGCC | SEQ ID NO: 521 |
| P53 | NM_000546.2 | CTTTGAACCCTTGCTTGCAATAGGTGTGCGTCAGAAGCACCCA GGACTTCCATTTGCTTTGTCCCGGG | SEQ ID NO: 522 |
| p53R2 | AB036063.1 | CCCAGCTAGTGTTCCTCAGAACAAAGATTGGAAAAAGCTGGCC GAGAACCATTTATACATAGAGGAAGGGCTTACGG | SEQ ID NO: 523 |
| PADI4 | NM_012387.1 | AGCAGTGGCTTGCTTTCTTCTCCTGTGATGTCCCAGTTTC CCACTCTGAAGATCCCAACATGGTCCTAGCA | SEQ ID NO: 524 |
| PAI1 | NM_000602.1 | CCGCAACGTGGTTTTCTCACCCTATGGGGTGGCCTCGGTG TTGGCCATGCTCCAGCTGACAACAGGAGGAGAAACCCAGCA | SEQ ID NO: 525 |
| Pak1 | NM_002576.3 | GAGCTGTGGGTTGTTATGGAATACTTGGCTGGAGGCTCCTTG ACAGATGTGGTGACAGAAACTTGCATGG | SEQ ID NO: 526 |
| PARC | NM_015089.1 | GGAGCTGACCTGCTTCCTACATCGCCTGGCCTCGATGCATA AGGACTATGCTGTGGTGCTCTGCT | SEQ ID NO: 527 |
| PCAF | NM_003884.3 | AGGTGGCTGTGTTACTGCAACGTGCCACAGTTCTGCGACAGTC TACCTCGGTACGAAACCACACAGGTG | SEQ ID NO: 528 |
| PCNA | NM_002592.1 | GAAGGTGTTGGAGGCACTCAAGGACCTCATCAACAGGCCTG CTGGGATATTAGCTCCAGCGGTGTAAACC | SEQ ID NO: 529 |
| PDGFA | NM_002607.2 | TTGTTGGTGTGCCCTGGTCCGTGGTGGCGGTCACTCC CTCTGCTGCCAGTGTTTGGACAGAACCCA | SEQ ID NO: 530 |
| PDGFB | NM_002608.1 | ACTGAAGGAGACCCTTGGAGCCTAGGGGCATCGGCAGGAG AGTGTGTGGGCAGGGTTATTTA | SEQ ID NO: 531 |
| PDGFC | NM_016205.1 | AGTTACTAAAAAATACCACGAGGTCCTTCAGTTGAGACCAA AGACCGGTGTCAGGGGATTGCACAAATCACTCACCGAC | SEQ ID NO: 532 |
| PDGFD | NM_025208.2 | TATCGAGGCAGGTCATACCATGACCGGAAGTCAAAAGTT GACCTGGATAGGCTCAATGATGATGCCAAGCGTTA | SEQ ID NO: 533 |
| PDGFRa | NM_006206.2 | GGGAGTTTCCAAGAGATGGACTAGTGCTTGGTCGGTCTTG GGGTCTGGAGCGTTTGGGAAGGTGGTTGAAG | SEQ ID NO: 534 |
| PDGFRb | NM_002609.2 | CCAGCTCTCCTTCCAGCTACAGATCAATGTCCCTGTCCGAGTG CTGGAGCTAAGTGAGAGCCACCC | SEQ ID NO: 535 |
| PFN1 | NM_005022.2 | GGAAAACGTTCGTCAACATCACGCCAGCTGAGGTGGGTGTC CTGGTTGGCAAAGACCGGTCAAGTTTT | SEQ ID NO: 536 |
| PFN2 | NM_053024.1 | TCTATACGTCGATGGTGACTGCACAATGGACATCCGGACAAA GAGTCAAGGTGGGGAGCCAACATACAATGTGGCTGTCGGC | SEQ ID NO: 537 |
| PGK1 | NM_000291.1 | AGAGCCAGTTGCTGTAGAACTCAAATCTCTGCTGGGCAAGGATGT TCTGTTCTTGAAGGACTGTGTAGGCCCAG | SEQ ID NO: 538 |
| PI3K | NM_002646.2 | TGCTACCTGGACAGCCCGTTGGTGCGCTTCCTCCTGAAACGAGCT GTGTCTGACTTGAGAGTGACTCACTACTTCTTCTGGTTACTGA AGGACGGCCT | SEQ ID NO: 539 |
| PI3KC2A | NM_002645.1 | ATACCAATCACCGCACAAACCCAGGCTATTTGTTAAGTCCAG TCACAGCGCAAAGAAACATATGCGGAGAAAATGCTAGTGTG | SEQ ID NO: 540 |
| PIK3CA | NM_006218.1 | GTGATTGAAGAGCATGCCAATTGGTCTGTATCCCGAGAAG CAGGATTTAGCTATTCCCACGCAGGAC | SEQ ID NO: 541 |

TABLE B-continued

| Gene | Locus Link | Sequence | SEQ ID NO |
|---|---|---|---|
| PIM1 | NM_002648.2 | CTGCTCAAGGACACCGTCTACACGGACTTCGATGG GACCCGAGTGTATAGCCCTCCAGAGTGGATCC | SEQ ID NO: 542 |
| Pin1 | NM_006221.1 | GATCAACGGCTACATCCAGAAGATCAAGTCGGAGAG GAGGACTTTGAGTCTCTGGCCTCACAGTTCA | SEQ ID NO: 543 |
| PKD1 | NM_000296.2 | CAGCACCAGCGATTACGACGTTGGCTGGGAGAGTCCTCAC AATGGCTCGGGGACGTGGGCCTATTCAG | SEQ ID NO: 544 |
| PKR2 | NM_002654.3 | CCGCCTGGACATTGATTCACCACCCATCACAGCCCGGAA CACTGGCATCATCTGTACCATTGGCCCAG | SEQ ID NO: 545 |
| PLA2G2A | NM_000300.2 | GCATCCCTCACCCATCCTAGAGGCCAGGCAGGAGCCCTTCT ATACCCACCCAGAATGAGACATCCAGCAGATTTCCAGC | SEQ ID NO: 546 |
| PLAUR | NM_002659.1 | CCCATGGATGCTCCTCTGAAGAGACTTTCCTCATTGAC TGCCGAGGCCCCATGAATCAATGTCTGGTAGCCACCGG | SEQ ID NO: 547 |
| PLK | NM_005030.2 | AATGAATACAGTATTCCCAAGCACATCAACCCCGTGGCCG CCTCCCTCATCCAGAAGATGCTTCAGACA | SEQ ID NO: 548 |
| PLK3 | NM_004073.2 | TGAAGGAGACGTACCGCTGCATCAAGCAGGTTCACTACACGCT GCCTGCCAGCCTCTCACTGCCTG | SEQ ID NO: 549 |
| PLOD2 | NM_000935.2 | CAGGGAGGTGGTTGCAAATTTCTAAGGTACAATTGCTCTATTGA GTCACCACGAAAAGGCTGGAGCTTCATGCATCCTGGGAGA | SEQ ID NO: 550 |
| PMS1 | NM_000534.2 | CTTACGGTTTTCGTGGAGAAGCTTGGGGTCAATTTGTTGTATA GCTGAGGTTTTAATTACAACAAGAACGGCTGCT | SEQ ID NO: 551 |
| PMS2 | NM_000535.2 | GATGTGGACTGCCATTCAAACCAGGAAGATACCGGATGTAAA TTTCGAGTTTTGCCTCAGCCAACTAATCTCGCA | SEQ ID NO: 552 |
| PPARG | NM_005037.3 | TGACTTTATGGAGCCCAAGTTTGAGTTTGCTGTGAAGTTCAAT GCACTGGAATTAGATGACAGCGACTTGGC | SEQ ID NO: 553 |
| PPID | NM_005038.1 | TCCTCATTTGGATGGGAAACATGTGGTGTTTGGCCAAGTAATTA AAGGAATAGGAGTGGCAAGGATATTGG | SEQ ID NO: 554 |
| PPM1D | NM_003620.1 | GCCATCCGCAAAGGCTTTCTCGCTTGTCACCTTGCCATG TGGAAGAAACTGGCGGAATGGCC | SEQ ID NO: 555 |
| PPP2R4 | NM_178001.1 | GGCTCAGAGCATAAGGCTTCAGGGCCCAAGTTGGGAGAAGTG ACCAAAGTGTAGCCAGTTTTCTGAGTTCCCGT | SEQ ID NO: 556 |
| PR | NM_000926.2 | GCATCAGGCTGTCATTATGGTGTCCTTACCTGTGGGAGCTGTAAGGT CTTCTTTAAGAGGGCAATGGAAGGGCAGCACAACTACT | SEQ ID NO: 557 |
| PRDX2 | NM_005809.4 | GGTGTCCTTCGCCAGATCACTGTTAATGATTTGCCTGTGGGA CGCTCCGTGGATGAGGCTCTGCGGCTG | SEQ ID NO: 558 |
| PRDX3 | NM_006793.2 | TGACCCCAATGGAGTCATCAAGCATTTGAGCGTCAACGATCTC CCAGTGGGCCGAAGCGTGGAAGAAACCCTCCGCTTGG | SEQ ID NO: 559 |
| PRDX4 | NM_006406.1 | TTACCCATTTGGCCTGGATTAATACCCCTCGAAGACAAGGAGG ACTTGGGCCAATAAGGATTCCACTTCTTTCAG | SEQ ID NO: 560 |
| PRDX6 | NM_004905.2 | CTGTGAGCCAGAGGATGTCAGCTGCCAATTGTGTTTTCCTGCA GCAATTCCATAAACACATCCTGGTGTCATCACA | SEQ ID NO: 561 |
| PRKCA | NM_002737.1 | CAAGCAATGCGTCATCAATGTCCCCAGCCTCTGCGGAATGGAT CACACTGAGAAGAGGGGGCGGATTTAC | SEQ ID NO: 562 |
| PRKCB1 | NM_002738.5 | GACCCAGCTCCACTCCTGCTTCCAGACCATGGACCGCCTGTA CTTTGTGATGGAGTACGTGAATGGG | SEQ ID NO: 563 |
| PRKCD | NM_006254.1 | CTGACACTTGCCGCAGAGAATCCCTTTCTCACCCACCTCATCTG CACCTTCCAGACCAAGGACCACCT | SEQ ID NO: 564 |
| PRKR | NM_002759.1 | GCGATACATGAGCCCAGAACAGATTCTTCGCAAGACTATGGAAGG AAGTGGACCTCTACGCTTTGGGGCTAATTCTTGCTGA | SEQ ID NO: 565 |
| pS2 | NM_003225.1 | GCCCTCCCAGTGTGCAAATAAGGGCTGCTGTTTCGACGACACCGTTC GTGGGGTCCCCTGGTGCTTCTATCCTAATACCATCGACG | SEQ ID NO: 566 |
| PTCH | NM_000264.2 | CCACGACAAAGCCGACTACATGCCTGAAACAAGGCTGAGAATCCCG GCAGCAGAGCCCATCGAGTA | SEQ ID NO: 567 |

TABLE B-continued

| Gene | Locus Link | Sequence | SEQ ID NO |
|---|---|---|---|
| PTEN | NM_000314.1 | TGGCTAAGTGAAGATGACAATCATGTTGCAGCAATTCACTGTAAA GCTGGAAAGGGACGAACTGGTGTAATGATATGTGCA | SEQ ID NO: 568 |
| PTGER3 | NM_000957.2 | TAACTGGGGCAACCTTTTCTTCGCCTCTGCCTTTGCCTTCCTGG GGCTCTTGGCGCTGACAGTCACCTTTTCCTGCAA | SEQ ID NO: 569 |
| PTHLH | NM_002820.1 | AGTGACTGGGAGTGGGCTAGAAGGGGACCACCTGTCTGACACCTCC ACAACGTCGCTGGAGCTCGATTCACGGTAACAGGCTT | SEQ ID NO: 570 |
| PTHR1 | NM_000316.1 | CGAGGTACAAGCTGAGATCAAGAAATCTTGGAGCCGCTGGACACTG GCACTGGACTTCAAGCGAAAGGCACGC | SEQ ID NO: 571 |
| PTK2 | NM_005607.3 | GACCGGTCGAATGATAAGGTGTACGAGAATGTGACGGGCCTGGTGA AAGCTGTCATCGAGATGTCCAG | SEQ ID NO: 572 |
| PTK2B | NM_004103.3 | CAAGCCCAGCCGACCTAAGTACAGACCCCCTCCGCAAACCAACC TCCTGGCTCCAAAGCTGCAGTTCCAGGTTC | SEQ ID NO: 573 |
| PTP4A3 | NM_007079.2 | AATATTTGTGCGGGGTATGGGGGTGGGTTTTTAAATCTCGTT TCTCTTGGACAAGCACAGGGATCTCGTT | SEQ ID NO: 574 |
| PTP4A3v2 | NM_032611.1 | CCTGTTCTCGGCACCTTAAATTATTAGACCCCGGGGCAGTC AGGTGCTCCGGACACCCGAAGGCAATA | SEQ ID NO: 575 |
| PTPD1 | NM_007039.2 | CGCTTGCCTAACTCATACTTTCCCGTTGACACTTGATCCACGCA GCGTGGCACTGGGACGTAAGTGGCGCAGTCTGAATGG | SEQ ID NO: 576 |
| PTPN1 | NM_002827.2 | AATGAGGAAGTTTCGGATGGGGCTGATCCAGACAGCCGACCAGC TGCGCTTCTCCTACCTGGCTGTGATCGAAG | SEQ ID NO: 577 |
| PTPRF | NM_002840.2 | TGTTTTAGCTGAGGGACGTGGTGCCGACGTCCCCAAACCTAGCT AGGCTAAGTCAAGATCAACATTCCAGGGTTGGTA | SEQ ID NO: 578 |
| PTPRJ | NM_002843.2 | AACTTCCGGTACCTCGTTCGTGACTACATGAAGCAGAGTCCTCCC GAATCGCCGATTCTGGTGCATTGCAGTGCT | SEQ ID NO: 579 |
| PTPRO | NM_030667.1 | CATGGCCTGATCATGGTGTGCCCACAGCAAATGCTGCAGAAAGTA TCCTGCAGTTTGTACACATGG | SEQ ID NO: 580 |
| PTTG1 | NM_004219.2 | GGCTACTCTGATCTATGTTGATAAGGAAATGGAGAACCAGGC ACCCGTGTGGTTGCTAAGGATGGGCTGAAGC | SEQ ID NO: 581 |
| RAB32 | NM_006834.2 | CCTGCAGCTGTGGGACATCGCGGGGCAGGAGCGATTTGGCA ACATGACCCGAGTATACTACAAGGAAGCTGTTGGTGCT | SEQ ID NO: 582 |
| RAB6C | NM_032144.1 | GCGACAGCTCCTCTAGTTCCACCATGTCCGCGGGCGGAGAC TTCGGGAATCCGCTGAGGAAATTCAAGCTGGTGTTCC | SEQ ID NO: 583 |
| RAC1 | NM_006908.3 | TGTTGTAAATGTCTCAGCCCCTCGTTCTTGGTCCTGTCC CTTGGAACCTTTGTACGCTTTGCTCAA | SEQ ID NO: 584 |
| RAD51C | NM_058216.1 | GAACTTCTTGAGCAGGAGCATACCCAGGGCTTCATAATCAC CTTCTGTTCAGCACTAGATGATATTCTTGGGGGTGGA | SEQ ID NO: 585 |
| RAD54L | NM_003579.2 | AGCTAGCCTCAGTGACACACATGACAGGTTGCACTGCCGACGTTGT GTCAACAGCCGTCAGATCCGG | SEQ ID NO: 586 |
| RAF1 | NM_002880.1 | CGTCGTATGCGAGAGTCTGTTTCCAGGATGCCTGTTAGTTCTCAG CACAGATATTCTACACCTCACGCCTTCA | SEQ ID NO: 587 |
| RALBP1 | NM_006788.2 | GGTGTCAGATATAAATGTGCAAATGCCTTCTTGCTGTCCTGTCG GTCTCAGTACGTTCACTTTATAGCTGCTGGCAATATCGAA | SEQ ID NO: 588 |
| RANBP2 | NM_006267.3 | TCCTTCAGCTTTCACACTGGGCTCAGAAATGAAGTTGCATGACTC TTCTGGAAGTCAGGTGGGAACAGGATTT | SEQ ID NO: 589 |
| ranBP7 | NM_006391.1 | AACATGATTATCCAAGCCGCTGGACTGCCATTGTGGACAAAATTGG CTTTTATCTTCAGTCCGATAACAGTGCTTGTTGGC | SEQ ID NO: 590 |
| RANBP9 | NM_005493.2 | CAAGTCAGTTGAGACGCCAGTTGTGTGGAGGAAGTCAGGCCGCCATAG AAAGAATGATCCACTTTGGACGAGAGCTGCA | SEQ ID NO: 591 |
| RAP1GDS1 | NM_021159.3 | TGTGGATGCTGGATTGATTTCACCACTGGTGCAGCTGCTAAATAGC AAAGACCAGGAAGTGCTGCTT | SEQ ID NO: 592 |
| RARA | NM_000964.1 | AGTCTGTGAGAAACGACCGAAACAAGAAGAAGAAGGAGGTGCCCAAGC CCGAGTGCTCTGAGAGCTACACGCTGACGCCG | SEQ ID NO: 593 |

TABLE B-continued

| Gene | Locus Link | Sequence | SEQ ID NO |
|------|------------|----------|-----------|
| RARB | NM_016152.2 | TGCCTGGACATCCTGATTCTTAGAATTTGCACCAGGTATACCCCAGAA CAAGACACCATGACTTTCTCAGACGGCCTT | SEQ ID NO: 594 |
| RASSF1 | NM_007182.3 | AGTGGGAGACACCTGACCTTTCTCAAGCTGAGATTGAGCAGAAGAT CAAGGAGTACAATGCCCAGATCA | SEQ ID NO: 595 |
| RBM5 | NM_005778.1 | CGAGAGGGAGAGCAAGACCATCATGCTGCGCGGCCTTCCCATCACCAT CACAGAGAGCGATATTCGAGA | SEQ ID NO: 596 |
| RBX1 | NM_014248.2 | GGAACCACATTATGGATCTTTGCATAGAATGTCAAGCTAACCAGGC GTCCGCTACTTCAGAAGAGTGTACTGTCGCATG | SEQ ID NO: 597 |
| RCC1 | NM_001269.2 | GGGCTGGGTGAGAATGTGATGGAGAGGAAGAAGCCGGCCCTGGTA TCCATTCCGGAGGATGTTGTG | SEQ ID NO: 598 |
| REG4 | NM_032044.2 | TGCTAACTCCTGCACAGCCCCGTCCTCTTCCTTTCTGCTAGCCT GGCTAAATCTGCTCATTATTTCAGAGGGGAAACCTAGCA | SEQ ID NO: 599 |
| RFC | NM_003056.1 | TCAAGACCATCATCACTTTCATTGTCTCGGACGTGCGGGGCCTGG GCCTCCCGGTCCGCAAGCAGTTCCAGTTATACTCCGTGTA CTTCCTGATCC | SEQ ID NO: 600 |
| RhoB | NM_004040.2 | AAGCATGAACAGGACTTGACCATCTTTCCAACCCCTGGGGA AGACATTTGCAACTGACTTGGGGAGG | SEQ ID NO: 601 |
| rhoC | NM_175744.1 | CCCGTTCGGTCTGAGGAAGGCCGGGACATGGCGAACCGGATCAG TGCCTTTGGCTACCTTGAGTGCTC | SEQ ID NO: 602 |
| RIZ1 | NM_012231.1 | CCAGACGAGCGATTAGAAGCGGCAGCTTGTGAGGTGAATGATTT GGGGGAAGAGGAGGAGGAGGAAGAGGAGGA | SEQ ID NO: 603 |
| RNF11 | NM_014372.3 | ACCCTGGAAGAGATGGATCAGAAAAAAAGATCCGGGAGTGTG TGATCTGTATGATGGACTTTGTTTATGGGGACCCAAT | SEQ ID NO: 604 |
| ROCK1 | NM_005406.1 | TGTGCACATAGGAATGAGCTTCAGATGCAGTTGGCCAGCAAAGAG AGTGATATTGAGCAATTGCGTGCTAAAC | SEQ ID NO: 605 |
| ROCK2 | NM_004850.3 | GATCCGAGACCCTCGCTCCCCCATCAACGTGGAGAGCTTGCTGGA TGGCTTAAATTCCTTGGTCCT | SEQ ID NO: 606 |
| RPLPO | NM_001002.2 | CCATTCTATCATCAACGGGTACAAACGAGTCCTGGCCTTG TCTGTGGAGACGGATTACACCTTCCCACTTGCTGA | SEQ ID NO: 607 |
| RPS13 | NM_001017.2 | CAGTCGGCTTTACCCTATCGACGCAGCGTCCCCACTTGGT TGAAGTTGACATCTGACGACGTGAAGGAGCAGA | SEQ ID NO: 608 |
| RRM1 | NM_001033.1 | GGGCTACTGGCAGCTACATTGCTGGGACTAATGGCAATTCCAA TGGCCTTGTACCGATGCTGAGAG | SEQ ID NO: 609 |
| RRM2 | NM_001034.1 | CAGCGGGATTAAACAGTCCTTTAACCAGCACAGCCAGTTAAA AGATGCAGCCTCACTGCTTCAACGCAGAT | SEQ ID NO: 610 |
| RTN4 | NM_007008.1 | GACTGGAGTGGTGTTTGGTGCCAGCCTATTCCTGCTGCTTTCAT TGACAGTATTCAGCATTGTGAGCGTAACAG | SEQ ID NO: 611 |
| RUNX1 | NM_001754.2 | AACAGAGACATTGCCAACCATATTGGATCTGCTTGCTGTCCAAA CCAGCAAACTTCCTGGGCAAATCAC | SEQ ID NO: 612 |
| RXRA | NM_002957.3 | GCTCTGTTGTGTCCTGTTGCCGGCTCTGGCCTTCCTGTGACTGACTG TGAAGTGGCTTCTCCGTAC | SEQ ID NO: 613 |
| S100A1 | NM_006271.1 | TGGACAAGGTGATGAAGGAGCTAGACGAGAATGGAGACGGGGAG GTGGACTTCCAGGAGTATGTGGTGCT | SEQ ID NO: 614 |
| S100A2 | NM_005978.2 | TGGCTGTGCTGGTCACTACCTTCCACAAGTACTCCTGCCAAGAG GGCGACAAGTTCAAGCTGAGTAAGGGGGA | SEQ ID NO: 615 |
| S100A4 | NM_002961.2 | GACTGCTGTCATGGCGTGCCCTCTGGAGAAGGCCCTGGATGTGA TGGTGTCCACCTTCCACAAGTACTCG | SEQ ID NO: 616 |
| S100A8 | NM_002964.3 | ACTCCCTGATAAAGGGGAATTTCCATGCCGTCTACAGGGATGAC CTGAAGAAATTGCTAGAGACCGAGTGTCCTCA | SEQ ID NO: 617 |
| S100A9 | NM_002965.2 | CTTTGGGACAGAGTGCAAGACGATGACTTGCAAAATGTCGCAGC TGGAACGCAACATAGAGACCA | SEQ ID NO: 618 |

TABLE B-continued

| Gene | Locus Link | Sequence | SEQ ID NO |
| --- | --- | --- | --- |
| S100P | NM_005980.2 | AGACAAGGATGCCGTGGATAAATTGCTCAAGGACCTGGACGCCAATGGAGATGCCCAGGTGGACTTC | SEQ ID NO: 619 |
| SAT | NM_002970.1 | CCTTTTACCACTGCCTGGTTGCAGAAGTGCCGAAAGAGCACTGGACTCCGGAAGGACACAGCATTGT | SEQ ID NO: 620 |
| SBA2 | NM_018639.3 | GGACTCAACGATGGGCAGATCAAGATCTGGGAGGTGCAGACAGGGCTCCTGCTTTTGAATCTTTCCG | SEQ ID NO: 621 |
| SDC1 | NM_002997.1 | GAAATTGACGAGGGGTGTCTTGGGCAGAGCTGGCTCTGAGCGCCTCCATCCAAGGCCAGGTTCTCCGTTAGCTCCT | SEQ ID NO: 622 |
| SEMA3B | NM_004636.1 | GCTCCAGGATGTGTTTCTGTTGTCCTCGCGGGACCACCGGACCCCGCTGCTCTATGCCGTCTTCTCCACGT | SEQ ID NO: 623 |
| SEMA3F | NM_004186.1 | CGCGAGCCCCTCATTATACACTGGGCAGCCTCCCCACAGCGCATCGAGGAATGCGTGCTCTCAGGCAAGGATGTCAACGGCGAGTG | SEQ ID NO: 624 |
| SEMA4B | NM_020210.1 | TTCCAGCCCAACACAGTGAACACTTTGGCCTGCCCGCTCCTCTCCAACCTGGCGACCCGACTC | SEQ ID NO: 625 |
| SFRP2 | NM_003013.2 | CAAGCTGAACGGTGTGTCCGAAAGGGACCTGAAGAAATCGGTGCTGTGGCTCAAAGACAGCTTGCA | SEQ ID NO: 626 |
| SFRP4 | NM_003014.2 | TACAGGATGAGGCTGGGCATTGCCTGGGACAGCCTATGTAAGGCCATGTGCCCCTTGCCCTAACAAC | SEQ ID NO: 627 |
| SGCB | NM_000232.1 | CAGTGGAGACCAGTTGGGTAGTGGTGACTGGGTACGCTACAAGCTCTGCATGTGTGCTGATGGGACGCTCTTCAAGG | SEQ ID NO: 628 |
| SHC1 | NM_003029.3 | CCAACACCTTCTTGGCTTCTGGGACCTGTGTTCTTGCTGAGCACCCTCTCCGGTTTGGGTTGGGATAACAG | SEQ ID NO: 629 |
| SHH | NM_000193.2 | GTCCAAGGCACATATCCACTGCTCGGTGAAAGCAGAGAACTCGGTGGCGGCCAAATCGGGAGGCTGCTTC | SEQ ID NO: 630 |
| SI | NM_001041.1 | AACGGACTCCCTCAATTTGTGCAAGATTTGCATGACCATGGACAGAAATATGTCATCATCTTGGACCCTGCAATTTC | SEQ ID NO: 631 |
| Siah-1 | NM_003031.2 | TTGGCATTGGAACTACATTCAATCCGCGGTATCCTCGGATTAGTTCTAGGACCCCCTTCTCCATACC | SEQ ID NO: 632 |
| SIAT4A | NM_003033.2 | AACCACAGTTGGAGGAGGACGGCAGAGACAGTTTCCCTCCCCGCTATACCAACACCCTTCCTTCG | SEQ ID NO: 633 |
| SIAT7B | NM_006456.1 | TCCAGCCCAAATCCTCCTGGTGGCACATCCTACCCCAGATGCTAAAGTGATTCAAGGACTCCAGGACACC | SEQ ID NO: 634 |
| SIM2 | NM_005069.2 | GATGGTAGGAAGGGATGTGCCCGCCTCTCCACGCACTCAGCTATACCTCATTCACAGCTCCTTGTG | SEQ ID NO: 635 |
| SIN3A | NM_015477.1 | CCAGAGTCATGCTCATCCAGCCCCACCAGTTGCACCAGTGCAGGGACAGCAGCAATTTCAGAGGCTGAAGGTGG | SEQ ID NO: 636 |
| SIR2 | NM_012238.3 | AGCTGGGGTGTCTGTTTCATGTGGAATACCTGACTTCAGGTCAAGGGATGGTATTTATGCTCGCCTTGCTGT | SEQ ID NO: 637 |
| SKP1A | NM_006930.2 | CCATTGCCTTTGCTTTGTTCATAATTTCAGCAGGGCAGAATAAAACCATGGGAGGCAAAGAAAGGAAATCCGGAA | SEQ ID NO: 638 |
| SKP2 | NM_005983.2 | AGTTGCAGAATCTAAGCCTGGAAGGCCTGCGGCTTTCGGATCCCATTGTCAATACTCTCGCAAAAACTCA | SEQ ID NO: 639 |
| SLC25A3 | NM_213611.1 | TCTGCCAGTGCTGAATTCTTTGCTGACATTGCCCTGGCTCCTATGGAAGCTGCTAAGGTTCGAA | SEQ ID NO: 640 |
| SLC2A1 | NM_006516.1 | GCCTGAGTCTCCTGTGCCCACATCCCAGGCTTCACCCTGAATGGTTCCATGCCTGAGGGTGGAGACT | SEQ ID NO: 641 |
| SLC31A1 | NM_001859.2 | CCGTTCGAAGAGTCGTGAGGGGGTGACGGGTTAAGATTCGGAGAGAGAGGTGCTAGTGGCTGGACT | SEQ ID NO: 642 |
| SLC5A8 | NM_145913.2 | CCTGCTTTCAACCACATTGAATTGAACTCAGATCAGAGTGGCAAGAGCAATGGGACTCGTTTGTGAAGCTGCTCT | SEQ ID NO: 643 |
| SLC7A5 | NM_003486.4 | GCGCAGAGGCCAGTTAAAGTAGATCACCTCCTCGAACCCACTCCGGTTCCCCGCAACCCACAGCTCAGCT | SEQ ID NO: 644 |

TABLE B-continued

| Gene | Locus Link | Sequence | SEQ ID NO |
|---|---|---|---|
| SLPI | NM_003064.2 | ATGGCCAATGTTTGATGCTTAACCCCCCCAATTTCTGTGAGATGG ATGGCCAGTGCAAGCGTGACTTGAAGTGT | SEQ ID NO: 645 |
| SMARCA3 | NM_003071.2 | AGGGACTGTCCTGGCACATTATGCAGATGTCCTGGGTCTTTT GCTTAGACTGCGGCAAATTTGTTG | SEQ ID NO: 646 |
| SNAI1 | NM_005985.2 | CCCAATCGGAAGCCTAACTACAGCGAGCTGCAGGACTCTAATCC AGAGTTTACCTTCCAGCAGCCCTAC | SEQ ID NO: 647 |
| SNAI2 | NM_003068.3 | GGCTGGCCAAACATAAGCAGCTGCACTGCGATGCCCAGTCTAGAA AATCTTTCAGCTGTAAATACTGTGACAAGGA | SEQ ID NO: 648 |
| SNRPF | NM_003095.1 | GGCTGGTCGGCAGAGAGTAGCCTGCAACATTCGGCCGTGGTTTAC ATGAGTTTACCCCTCAATCCCAAACCTTTCCTCA | SEQ ID NO: 649 |
| SOD1 | NM_000454.3 | TGAAGAGAGGCATGTTGGAGACTTGGGCAATGTGACTGCTGACAAA GATGGTGTGGCCGATGTGTCTATT | SEQ ID NO: 650 |
| SOD2 | NM_000636.1 | GCTTGTCCAAATCAGGATCCACTGCAAGGAACAACAGGCCTTATTC CACTGCTGGGGATTGATGTGTGGGAGCACGCT | SEQ ID NO: 651 |
| SOS1 | NM_005633.2 | TCTGCACCAAATTCTCCAAGAACACCGTTAACACCTCCGCCTGCTT CTGGTGCTTCCAGTACCAC | SEQ ID NO: 652 |
| SOX17 | NM_022454.2 | TCGTGTGCAAGCCTGAGATGGGCCTCCCCTACCAGGGGCATG ACTCCGGTGTGAATCTCCCCGACAG | SEQ ID NO: 653 |
| SPARC | NM_003118.1 | TCTTCCCTGTACACTGGCAGTTCGGCCAGCTGGACCAGCAC CCCATTGACGGGTACCTCTCCCACACCGAGCT | SEQ ID NO: 654 |
| SPINT2 | NM_021102.1 | AGGAATGCAGCGGATTCCTCTGTCCCAAGTGCTCCCAGAAG GCAGGATTCTGAAGACCACTCCAGCGA | SEQ ID NO: 655 |
| SPRY1 | AK026960.1 | CAGACCAGTCCCTGGTCATAGGTCTGAAAGGGCAATCCGGAC CCAGCCCAAGCAACTGATTGTGGATGACTTGAAGG | SEQ ID NO: 656 |
| SPRY2 | NM_005842.1 | TGTGGCAAGTGCAAATGTAAGGAGTGCACCTACCCAAGGC CTCTGCCATCAGACTGGATCTGCGAC | SEQ ID NO: 657 |
| SR-A1 | NM_021228.1 | AGATGGAAGAAGCCAACCTGGCGAGCCGAGCGAAGGCCCAGGA GCTGATCCAGGCCACCAACCAGATCCTCAGCCACAG | SEQ ID NO: 658 |
| ST14 | NM_021978.2 | TGACTGCACATGGAACATTGAGGTGCCCAACAACCAGCATGTG AAGGTGCGCTTCAAATTCTT | SEQ ID NO: 659 |
| STAT1 | NM_007315.1 | GGGCTCAGCTTTCAGAAGTGCTGAGTTGGCAGTTTTCTTCTGTC ACCAAAAGAGGTCTCAATGTGGACCAGCTGAACATGT | SEQ ID NO: 660 |
| STAT3 | NM_003150.1 | TCACATGCCACTTTGGTGTTTCATAATCTCCTGGGAGAGAT TGACCAGCAGTATAGCCGCTTCCTGCAAG | SEQ ID NO: 661 |
| STAT5A | NM_003152.1 | GAGGCGCTCAACATGAAATTCAAGGCCGAAGTGCAGAGCAACC GGGGCCTGACCAAGGAGAACCTCGTGTTCCTGGC | SEQ ID NO: 662 |
| STAT5B | NM_012448.1 | CCAGTGGTGGTGATCGTTCATGGCAGCCAGGACAACAATGCGAC GGCCACTGTTCTCTGGGACAATGCTTTTGC | SEQ ID NO: 663 |
| STC1 | NM_003155.1 | CTCCGAGGTGAGGAGGACTCTCCCTCCCACATCAAACGCACATCC CATGAGAGTGCATAACCAGGGAGAGGT | SEQ ID NO: 664 |
| STK11 | NM_000455.3 | GGACTCGGAGACGCTGTGCAGGAGGGCCGTCAAGATCCTCAAGAAG AAGAAGTTGCGAAGGATCCC | SEQ ID NO: 665 |
| STK15 | NM_003600.1 | CATCTTCCAGGAGGACCACTCTCTGTGGCACCCTGGACTACCTGC CCCCTGAAATGATTGAAGGTCGGA | SEQ ID NO: 666 |
| STMN1 | NM_005563.2 | AATACCCAACGCACAAATGACCGCACGTTCTCTGCCCCGTTTCTTG CCCCAGTGTGGTTTGCATTGTCTCC | SEQ ID NO: 667 |
| STMY3 | NM_005940.2 | CCTGGAGGCTGCAACATACCTCAATCCTGTCCCAGGCCGGATCCT CCTGAAGCCCTTTTCGCAGCACTGCTATCCTCCAAAGCCATTGTA | SEQ ID NO: 668 |
| STS | NM_000351.2 | GAAGATCCCTTTCCTCCTACTGTTCTTTCTGTGGGAAGCCGAGAGC CACGAAGCATCAAGGCCGAACATCATCC | SEQ ID NO: 669 |
| SURV | NM_001168.1 | TGTTTTGATTCCCGGGCTTACCAGGTGAGAAGTGAGGGAGGAAGA AGGCAGTGTCCCTTTTGCTAGAGCTGACAGCTTTG | SEQ ID NO: 670 |

TABLE B-continued

| Gene | Locus Link | Sequence | SEQ ID NO |
|---|---|---|---|
| TAGLN | NM_003186.2 | GATGGAGCAGGTGGCTCAGTTCCTGAAGGCGGCTGAGGACTCTG GGGTCATCAAGACTGACATGTTCCAGACT | SEQ ID NO: 671 |
| TBP | NM_003194.1 | GCCCGAAACGCCGAATATAATCCCAAGCGGTTTGCTGCGGTAATCA TGAGGATAAGAGAGCCACG | SEQ ID NO: 672 |
| TCF-1 | NM_000545.3 | GAGGTCCTGAGCACTGCCAGGAGGGACAAAGGAGCCTGTGAACC CAGGACAAGCATGGTCCCACATC | SEQ ID NO: 673 |
| TCF-7 | NM_003202.2 | GCAGCTGCAGTCAACAGTTCAAAGAAGTCATGGCCCAAATC CAGTGTGCACCCCTCCCCATTCACAG | SEQ ID NO: 674 |
| TCF7L1 | NM_031283.1 | CCGGGACACTTTCCAGAAGCCGCGGGACTATTTCGCCGAAGT GAGAAGGCCTCAGGACAGCGCGTTCT | SEQ ID NO: 675 |
| TCF7L2 | NM_030756.1 | CCAATCACGACAGGAGGATTCAGACACCCCTACCCCACAGCTC TGACCGTCAATGCTTCCGTGTCCA | SEQ ID NO: 676 |
| TCFL4 | NM_170607.2 | CTGACTGCTCTGCTTAAAGGTGAAAGTAGCAGGAACAACAACA AAAGCCAACCAAAAACAAGGTAGCCAGTGCAAGACAT | SEQ ID NO: 677 |
| TEK | NM_000459.1 | ACTTCGGTGCTACTTAACAACTTACATCCCAGGGAGCAGTACGTG GTCCGAGCTAGAGTCAACACCAAGGCCCAGG | SEQ ID NO: 678 |
| TERC | U86046.1 | AAGAGGAACGGAGCGAGTCCCCGCGCGCGGCGCGATTCCCTGAGCTGTG GGACGTGCACCCAGGACTCGGCTCACACAT | SEQ ID NO: 679 |
| TERT | NM_003219.1 | GACATGGAGAACAAGCTGTTTGCGGGGATTCGGCGGGACGG GCTGCTCCTGCGTTTGGTGGATGATTTCTTGTTGGTGACACCTC | SEQ ID NO: 680 |
| TFF3 | NM_003226.1 | AGGCACTGTTCATCTCAGTTTTTCTGTCCCTTTGCTCCCGGCAAGC TTTCTGCTGAAAGTTCATATCTGGAGCCTGATG | SEQ ID NO: 681 |
| TGFA | NM_003236.1 | GGTGTGCCACAGACCTTCCTACTTGGCCTGTAATCACCTGTGCAGCCT TTTGTGGGCCTTCAAAACTCTGTCAAGAACTCCGT | SEQ ID NO: 682 |
| TGFB2 | NM_003238.1 | ACCAGTCCCCCAGAAGACTATCCTGAGCCCGAGGAAGTCCCCCCG GAGGTGATTTCCATCTACAACAGCACCAGG | SEQ ID NO: 683 |
| TGFB3 | NM_003239.1 | GGATCGAGCTCTTCCAGATCCTTCGGCCAGATGAGCACATTGCCAAA CAGCGCTATATCGGTGGC | SEQ ID NO: 684 |
| TGFBI | NM_000358.1 | GCTACGAGTGCTGTCCTGGATATGAAAAGGTCCCTGGGGAGAAGGGC TGTCCAGCAGCCCTACCACT | SEQ ID NO: 685 |
| TGFBR1 | NM_004612.1 | GTCATCACCTGGCCTTGGTCCTGTGGAACTGGCAGCTGTCATTGCTGGA CCAGTGTGCTTCGTCTGC | SEQ ID NO: 686 |
| TGFBR2 | NM_003242.2 | AACACCAATGGGTTCCATCTTTCTGGGCTCCTGATTGCTCAAGCACA GTTTGGCCTGATGAAGAGG | SEQ ID NO: 687 |
| THBS1 | NM_003246.1 | CATCCGCAAAGTGACTGAAGAGAACAAAGAGTTGGCCAATGAGCT GAGGCGGCCTCCCCTATGCTATCACAACGGAGTTCAGTAC | SEQ ID NO: 688 |
| THY1 | NM_006288.2 | GGACAAGACCCTCTCAGGCTGTCCCAAGCTCCCAAGAGCTTCCAGA GCTCTGACCCACAGCCTCCAA | SEQ ID NO: 689 |
| TIMP1 | NM_003254.1 | TCCCTGCGGTCCCAGATAGCCTGAATCCTGCCCGGAGTGGAACT GAAGCCTGCACAGTGTCCACCCTGTTCCCAC | SEQ ID NO: 690 |
| TIMP2 | NM_003255.2 | TCACCCTCTGTGACTTCATCGTGCCCTGGGACACCCTGAGCACC ACCCAGAAGAAGAGCCTGAACCACA | SEQ ID NO: 691 |
| TIMP3 | NM_000362.2 | CTACCTGCCTTGCTTTGTGACTTCCAAGAACGAGTGTCTCTGGA CCGACATGCTCTCCAATTTCGGT | SEQ ID NO: 692 |
| TJP1 | NM_003257.1 | ACTTTGCTGGGACAAAGGTCAACTGAAGAAGTGGGCAGGCCCGAG GCAGGAGAGATGCTGAGGAGTCCATGTG | SEQ ID NO: 693 |
| TK1 | NM_003258.1 | GCCGGGAAGACCGTAATTGTGGCTGCACTGGATGGGACCTTCCA GAGGAAGCCATTTGGGGCCATCCTGAACCTGGTGCCGCTG | SEQ ID NO: 694 |
| TLN1 | NM_006289.2 | AAGCAGAAGGGAGAGCGTAAGATCTTCCAGGCACACAAGAATT GTGGGCAGATGAGTGAGATTGAGGCCAAGG | SEQ ID NO: 695 |
| TMEPAI | NM_020182.3 | CAGAAGGATGCCTGTGGCCCTCGGAGAGCACAGTGTCAGGCAAC GGAATCCCAGAGCCGCAGGTCTAC | SEQ ID NO: 696 |

TABLE B-continued

| Gene | Locus Link | Sequence | SEQ ID NO |
|---|---|---|---|
| TMSB10 | NM_021103.2 | GAAATCGCCAGCTTCGATAAGGCCAAGCTGAAGAAAACGGAGAC GCAGGAAAAGAACACCCTGCCGAC | SEQ ID NO: 697 |
| TMSB4X | NM_021109.2 | CACATCAAAGAACTACTGACAACGAAGGCCGCGCCTGCCTTTCCC ATCTGTCTATCTATCTGGCTGGCAGG | SEQ ID NO: 698 |
| TNC | NM_002160.1 | AGCTCGGAACCTCACCGTGCCTGGCAGCCTTCGGGCTGTGGACATACC GGGCCTCAAGGCTGCTAC | SEQ ID NO: 699 |
| TNF | NM_000594.1 | GGAGAAGGGTGACCGACTCAGCGCTGAGATCAATCGGCCCGACTATC TCGACTTTGCCGAGTCTGGGCA | SEQ ID NO: 700 |
| TNFRSF5 | NM_001250.3 | TCTCACCTCGCTATGGTTCGTCTGCCTCTGCAGTGCGTCCTCT GGGGCTGCTTGCTGACCGCTGTCCATC | SEQ ID NO: 701 |
| TNFRSF6B | NM_003823.2 | CCTCAGCACCAGGGTACCAGGAGCTGAGGAGTGTGAGCGTG CCGTCATCGACTTTGTGGCTTTCCAGGACA | SEQ ID NO: 702 |
| TNFSF4 | NM_003326.2 | CTTCATCTTCCCTCTACCCAGATTGTGAAGATGGAAAGGGTCC AACCCCTGGAAGAGAATGTGGGAAATGCAGC | SEQ ID NO: 703 |
| TOP2A | NM_001067.1 | AATCCAAGGGGGAGAGTGATGACTTCCATATGGACTTTGACTCAG CTGTGGCTCCTCGGGCAAAATCTGTAC | SEQ ID NO: 704 |
| TOP2B | NM_001068.1 | TGTGGACATCTTCCCCTCAGACTTCCCTACTGAGCCACCTTCTC TGCCACGAACCGGTCGGGCTAG | SEQ ID NO: 705 |
| TP | NM_001953.2 | CTATATGCAGCCAGAGATGTGACAGCCACCGTGGACAGCCTGCCAC TCATCACAGCCTCCATTCTCAGTAAGAAACTCGTGG | SEQ ID NO: 706 |
| TP53BP1 | NM_005657.1 | TGCTGTTGCTGAGTCTGTTGCCAGTCCCCAGAAGACCATGTC TGTGTTGAGCTGTATCTGTGAAGCCAGGCAAG | SEQ ID NO: 707 |
| TP53BP2 | NM_005426.1 | GGGCCAAATATTCAGAAGCTTTTATATCAGAGGACCACCAT AGCGGCCATGGAGACCATCTCTGTCCCATCATACCCATCC | SEQ ID NO: 708 |
| TP53I3 | NM_004881.2 | GCGGACTTAATGCAGAGACAAGGCCAGTATGACCCACCTCC AGGAGCCAGCAACATTTTGGGACTTGA | SEQ ID NO: 709 |
| TRAG3 | NM_004909.1 | GACGCTGGTCTGGTGAAGATGTCCAGGAAACCACGAGCCTCC AGCCCATTGTCCAACAACCACCCA | SEQ ID NO: 710 |
| TRAIL | NM_003810.1 | CTTCACAGTGCTCCTGCAGTCTCTCTGTGTGGCTGTAACTTACG TGTACTTTACCAACGAGCTGAAGCAGATG | SEQ ID NO: 711 |
| TS | NM_001071.1 | GCCTCGGTGTGCCTTTCAACATCGCCAGCTACGCCCTGCTCACGTACA TGATTGCGCACATCACG | SEQ ID NO: 712 |
| TST | NM_003312.4 | GGAGCCGGATGCAGTAGGACTGGACTCGGGCCATATCCGTGGTGC CGTCAACATGCCTTTCATGGACTT | SEQ ID NO: 713 |
| TUBA1 | NM_006000.1 | TGTCACCCCGACTCAACGTGAGACGCACCGCCCGGACTCACCA TGCGTGAATGCATCTCAGTCCACGT | SEQ ID NO: 714 |
| TUBB | NM_001069.1 | CGAGGACGAGGCTTAAAAACTTCTCAGATCAATCGTGCATCCT TAGTGAACTTCTGTTGTCCTCAAGCATGGT | SEQ ID NO: 715 |
| TUFM | NM_003321.3 | GTATCACCATCAATGCGGCTCATGTGGAGTATAGCACTGCCGCC CGCCACTACGCCCACACAGACTG | SEQ ID NO: 716 |
| TULP3 | NM_003324.2 | TGTGTATAGTCCTGCCCCTCAAGGTGTCACAGTAAGATGTCGG ATAATCCGGGATAAAAGGGGAATGGATCGGG | SEQ ID NO: 717 |
| tusc4 | NM_006545.4 | GGAGGAGCTAAATGCCTCAGGCCGGTGCACTCTGCCCATTGAT GAGTCCAACACCATCCACTTGAAGG | SEQ ID NO: 718 |
| UBB | NM_018955.1 | GAGTCGACCCTGCACCTGGTCCTGCGTCTGAGAGGTGGTATGCAGA TCTTCGTGAAGACCCTGACCGGCAAGACCATCACCCTGGA AGTGGAGCCCAGTGACACCATCGAAAATGTGAAGGCCAAGA TCCAGGATAAAGAAGGCATCCCTCCCGACCAGCAGAGGCTC ATCTTTGCAGGCAAGCAGCTGGAAGATGGCCGCACTCTTTCT GACTACAACATCCAGAAGGAGTCGACCCTGCACCTGGTCCTG CGTCTGAGAGGTGGTATGCAGATCTTCGTGAAGACCCTGACC GGCAAGACCATCACTCTGGAAGTGGAGCCCAGTGACACCATC GAAAATGTGAAGGCCAAGATCCAAGATAAAGAAGGCATCCCT CCCGACCAGCAGAGGCTCATCTTTGCAGGCAAGCAGCTGGAA GATGGCCGCACTCTTTCTGACTACAACATCCAGAAGGAGTCG | SEQ ID NO: 719 |

TABLE B-continued

| Gene | Locus Link | Sequence | SEQ ID NO |
|---|---|---|---|
| | | ACCCTGCACCTGGTCCTGCGCCTGAGGGGTGGCTGTTAATTC TTCAGTCATGGCATTCGC | |
| UBC | NM_021009.2 | ACGCACCCTGTCTGACTACAACATCCAGAAAGAGTCCACCC TGCACCTGGTGCTCCGTCTTAGAGGT | SEQ ID NO: 720 |
| UBE2C | NM_007019.2 | TGTCTGGCGATAAAGGGATTTCTGCCTTCCCTGAATCAGA CAACCTTTTCAAATGGGTAGGGACCAT | SEQ ID NO: 721 |
| UBE2M | NM_003969.1 | CTCCATAATTTATGGCCTGCAGTATCTCTTCTTGGAGCCCA ACCCCGAGGACCCACTGAACAAGGAGGCCGCA | SEQ ID NO: 722 |
| UBL1 | NM_003352.3 | GTGAAGCCACCGTCATCATGTCTGACCAGGAGGCAAAACCTTC AACTGAGGACTTGGGGGATAAGAAGGAAGG | SEQ ID NO: 723 |
| UCP2 | NM_003355.2 | ACCATGCTCCAGAAGGAGGGGCCCCGAGCCTTCTACAAAGGGT TCATGCCCTCCTTTCTCCGCTTGGGTT | SEQ ID NO: 724 |
| UGT1A1 | NM_000463.2 | CCATGCAGCCTGGAATTTGAGGCTACCCAGTGCCCCAACCCAT TCTCCTACGTGCCCAGGCCTCTC | SEQ ID NO: 725 |
| UMPS | NM_000373.1 | TGCGGAAATGAGCTCCACCGGCTCCCTGGCCACTGGGGACTACAC TAGAGCAGCGGTTAGAATGGCTGAGG | SEQ ID NO: 726 |
| UNC5A | XM_030300.7 | GACAGCTGATCCAGGAGCCACGGGTCCTGCACTTCAAGGACAGT TACCACAACCTGCGCCTATCCAT | SEQ ID NO: 727 |
| UNC5B | NM_170744.2 | AGAACGGAGGCCGTGACTGCAGCGGGACGCTGCTCGACTCTAAGA ACTGCACAGATGGGCTGTGCATG | SEQ ID NO: 728 |
| UNC5C | NM_003728.2 | CTGAACACAGTGGAGCTGGTTTGCAAACTCTGTGTGCGGCAGGTGG AAGGAGAAGGGCAGATCTTCCAG | SEQ ID NO: 729 |
| upa | NM_002658.1 | GTGGATGTGCCCTGAAGGACAAGCCAGGCGTCTACACGAGAGTCTCA CACTTCTTACCCTGGATCCGCAG | SEQ ID NO: 730 |
| UPP1 | NM_003364.2 | ACGGGTCCTGCCTCAGTTGGCGGAATGGCGGCCACGGGAGCCAATG CAGAGAAAGCTGAAAGTCACAATGATTGCCCCG | SEQ ID NO: 731 |
| VCAM1 | NM_001078.2 | TGGCTTCAGGAGCTGAATACCCTCCCAGGCACACACAGGTGGGAC ACAAATAAGGGTTTTGGAACCACTATTTTCTCATCACGACAGCA | SEQ ID NO: 732 |
| VCL | NM_003373.2 | GATACCACAACTCCCATCAAGCTGTTGGCAGTGGCAGCCACGGCGCC TCCTGATGCGCCTAACAGGGA | SEQ ID NO: 733 |
| VCP | NM_007126.2 | GGCTTTGGCAGCTTCAGATTCCCTTCAGGGAACCAGGGTGGAGCTGG CCCCAGTCAGGGCAGTGGAG | SEQ ID NO: 734 |
| VDAC1 | NM_003374.1 | GCTGCGACATGGATTTCGACATTGCTGGGCCTTCCATCCGGGGTG CTCTGGTGCTAGGTTACGAGGGCTGG | SEQ ID NO: 735 |
| VDAC2 | NM_003375.2 | ACCCACGGACAGACTTGCGCGCGTCCAATGTGTATTCCTCCATC ATATGCTGACCTTGGCAAAGCT | SEQ ID NO: 736 |
| VDR | NM_000376.1 | GCCCTGGATTTCAGAAAGAGCCAAGTCTGGATCTGGGACCCTTTCC TTCCTTCCCTGGCTTGTAACT | SEQ ID NO: 737 |
| VEGF | NM_003376.3 | CTGCTGTCTTGGGTGCATTGGAGCCTTGCCTTGCTGCTCTACCTC CACCATGCCAAGTGGTCCCAGGCTGC | SEQ ID NO: 738 |
| VEGF_altsplice1 | AF486837.1 | TGTGAATGCAGACCAAAGAAAGATAGAGCAAGACA AGAAAATCCCTGTGGGCCTTGCTCAGAGCGGAGAAAGC | SEQ ID NO: 739 |
| VEGF_altsplice2 | AF214570.1 | AGCTTCCTACAGCACAACAAATGTGAATGCAGACCA AAGAAAGATAGAGCAAGACAAGAAAATGTGACAAGCCGAG | SEQ ID NO: 740 |
| VEGFB | NM_003377.2 | TGACGATGGCCTGGAGTGTGTGCCCACTGGGCAGCACCAAGTCC GGATGCAGATCCTCATGATCCGGTACC | SEQ ID NO: 741 |
| VEGFC | NM_005429.2 | CCTCAGCAAGACGTTATTTGAAATTACAGTGCCTCTCTCTCAA GGCCCCAAACCAGTAACAATCAGTTTTGCCAATCACACTT | SEQ ID NO: 742 |
| VIM | NM_003380.1 | TGCCCTTAAAGGAACCAATGAGTCCCTGGAACGCCAGATGCGTGA AATGGAAGAGAACTTTGCCGTTGAAGC | SEQ ID NO: 743 |
| WIF | NM_007191.2 | TACAAGCTGAGTGCCCAGGCGGGTGCCGAAATGGAGGCTTTTG TAATGAAAGACGCATCTGCGAGTG | SEQ ID NO: 744 |

TABLE B-continued

| Gene | Locus Link | Sequence | SEQ ID NO |
|---|---|---|---|
| WISP1 | NM_003882.2 | AGAGGCATCCATGAACTTCACACTTGCGGGCTGCATCAGC ACACGCTCCTATCAACCCAAGTACTGTGGAGTTTG | SEQ ID NO: 745 |
| Wnt-3a | NM_033131.2 | ACAAAGCTACCAGGGAGTCGGCCTTTGTCCACGCCATTGC CTCAGCCGGTGTGGCCTTTGCAGTGACACGCTCA | SEQ ID NO: 746 |
| Wnt-5a | NM_003392.2 | GTATCAGGACCACATGCAGTACATCGGAGAAGGCGCGAAGA CAGGCATCAAAGAATGCCAGTATCAATTCCGACA | SEQ ID NO: 747 |
| Wnt-5b | NM_032642.2 | TGTCTTCAGGGTCTTGTCCAGAATGTAGATGGGTTCCGTAAGAG GCCTGGTGCTCTCTTACTCTTTCATCCACGTGCAC | SEQ ID NO: 748 |
| WNT2 | NM_003391.1 | CGGTGGAATCTGGCTCTGGCTCCCTCTGCTCTTGACCTGGCTC ACCCCCGAGGTCAACTCTTCATGG | SEQ ID NO: 749 |
| WWOX | NM_016373.1 | ATCGCAGCTGGTGGGTGTACACACTGCTGTTTACCTTGGCGA GGCCTTTCACCAAGTCCATGCAACAGGGAGCT | SEQ ID NO: 750 |
| XPA | NM_000380.2 | GGGTAGAGGGAAAAGGGTTCAACAAAGGCTGAACTGGATTCT TAACCAAGAAACAAATAATAGCAATGGTGGTGCA | SEQ ID NO: 751 |
| XPC | NM_004628.2 | GATACATCGTCTGCGAGGAATTCAAAGACGTGCTCCTGACTGC CTGGGAAAATGAGCAGGCAGTCATTGAAAG | SEQ ID NO: 752 |
| XRCC1 | NM_006297.1 | GGAGATGAAGCCCCCAAGCTTCCTCAGAAGCAACGCCAGAC CAAAACCAAGCCCACTCAGGCAGCTGGAC | SEQ ID NO: 753 |
| YB-1 | NM_004559.1 | AGACTGTGGAGTTTGATGTTGTTGAAGGAGAAAAGGGTGCGGA GGCAGCAAATGTTACAGGTCCTGGTGGTGTTCC | SEQ ID NO: 754 |
| YWHAH | NM_003405.2 | CATGGCCTCCGCTATGAAGGCGGTGACAGAGCTGAATGAACCT CTCTCCAATGAAGATCGAAATCTCC | SEQ ID NO: 755 |
| zbtb7 | NM_015898.2 | CTGCGTTCACACCCCAGTGTCACAGGGCGAGCTGTTCTGGAGAG AAAACCATCTGTCGTGGCTGAG | SEQ ID NO: 756 |
| ZG16 | NM_152338.1 | TGCTGAGCCTCCTCTCCTTGGCAGGGCACTGTGATGAGGAGTAA GAACTCCCTTATCACTAACCCCCATCC | SEQ ID NO: 757 |

TABLE C

| Variable | out1 | out2 | out3 |
|---|---|---|---|
| AMFR_1 | IGFBP7_1 | AXIN1_1 | HSPG2_1 |
| AMFR_1 | 0.3721 | 0.3298 | 0.3072 |
| ANXA1_2 | CTSB_1 | PKR2_1 | UPA_3 |
| ANXA1_2 | 0.5989 | 0.5649 | 0.5216 |
| APC_4 | ROCK1_1 | TLN1_1 | ITGB1_1 |
| APC_4 | 0.3982 | 0.3672 | 0.365 |
| AURKB_1 | PLK_3 | KIFC1_1 | CDC20_1 |
| AURKB_1 | 0.5351 | 0.5327 | 0.5185 |
| AXIN_2_3 | NKD_1_1 | CDX2_3 | CRIPTO_TDGF1_OFFICIAL_1 |
| AXIN_2_3 | 0.7163 | 0.6605 | 0.6388 |
| BGN_1 | COL1A1_1 | SPARC_1 | TIMP2_1 |
| BGN_1 | 0.8986 | 0.8711 | 0.8446 |
| BIK_1 | TS_1 | ATP5E_1 | DHFR_2 |
| BIK_1 | 0.3266 | −0.3247 | 0.3132 |
| BRAF_5 | ITGB1_1 | CREBBP_1 | ITGAV_1 |
| BRAF_5 | 0.4156 | 0.4007 | 0.3952 |
| BRAF_SNP1_6 | AXIN_2_3 | CDX2_3 | REG4_1 |
| BRAF_SNP1_6 | −0.4564 | −0.4561 | 0.4075 |
| BRCA2_2 | C20_ORF1_1 | CLIC1_1 | KIFC1_1 |
| BRCA2_2 | 0.3042 | 0.2484 | 0.2448 |
| BUB1_1 | CDC2_1 | CDC20_1 | KI_67_2 |
| BUB1_1 | 0.5865 | 0.5539 | 0.5398 |
| B_CATENIN_3 | CRIPTO_TDGF1_OFFICIAL_1 | PTCH_1 | NKD_1_1 |
| B_CATENIN_3 | 0.4659 | 0.4524 | 0.4522 |
| C20ORF126_1 | CSEL1_1 | ATP5E_1 | C20_ORF1_1 |
| C20ORF126_1 | 0.5815 | 0.5313 | 0.5022 |
| C20_ORF1_1 | MYBL2_1 | PLK_3 | C20ORF126_1 |
| C20_ORF1_1 | 0.5644 | 0.509 | 0.5022 |
| CALD1_2 | IGFBP5_1 | TAGLN_3 | CDH11_1 |
| CALD1_2 | 0.7483 | 0.7452 | 0.7339 |
| CASP9_1 | TAGLN_3 | TGFBR1_1 | HSPG2_1 |
| CASP9_1 | 0.2373 | 0.2194 | 0.2189 |

TABLE C-continued

| | | | | | | |
|---|---|---|---|---|---|---|---|
| CCNE2_2 | | CCNE2_VARIANT_1_1 | | MCM2_2 | | BGN_1 | |
| CCNE2_2 | 0.4225 | | 0.3667 | | −0.3646 | | |
| CCNE2_VARIANT_1_1 | | CCNE2_2 | | RRM2_1 | | MAD2L1_1 | |
| CCNE2_VARIANT_1_1 | 0.4225 | | 0.4098 | | 0.3889 | | |
| CD44E_1 | | CD44V6_1 | | HNRPAB_3 | | RRM2_1 | |
| CD44E_1 | 0.5418 | | 0.4304 | | 0.421 | | |
| CD44S_1 | | MCP1_1 | | CTSL_2 | | SOD2_1 | |
| CD44S_1 | 0.6091 | | 0.6046 | | 0.5965 | | |
| CD44V6_1 | | CD44E_1 | | RBX1_1 | | HIF1A_3 | |
| CD44V6_1 | 0.5418 | | 0.3956 | | 0.3886 | | |
| CD68_2 | | CTSL_2 | | CTSB_1 | | CD18_2 | |
| CD68_2 | 0.6148 | | 0.579 | | 0.5754 | | |
| CDC2_1 | | KI_67_2 | | MAD2L1_1 | | BUB1_1 | |
| CDC2_1 | 0.6905 | | 0.6217 | | 0.5865 | | |
| CDC4_1 | | ITGAV_1 | | DPYD_2 | | PDGFRA_2 | |
| CDC4_1 | 0.3472 | | 0.3128 | | 0.2809 | | |
| CDH11_1 | | SPARC_1 | | TIMP2_1 | | IGFBP7_1 | |
| CDH11_1 | 0.7831 | | 0.7629 | | 0.7587 | | |
| CDX2_3 | | AXIN_2_3 | | CRIPTO_TDGF1_OFFICIAL_1 | | CAD17_1 | |
| CDX2_3 | 0.6605 | | 0.6374 | | 0.5944 | | |
| CENPA_1 | | PLK_3 | | CKS2_2 | | BUB1_1 | |
| CENPA_1 | 0.4964 | | 0.4381 | | 0.4355 | | |
| CENPF_1 | | TOP2A_4 | | KIFC1_1 | | AURKB_1 | |
| CENPF_1 | 0.4655 | | 0.4649 | | 0.461 | | |
| CHFR_1 | | TIMP2_1 | | TLN1_1 | | MYLK_1 | |
| CHFR_1 | 0.3942 | | 0.3921 | | 0.3912 | | |
| CHK1_2 | | CCNA2_1 | | CCNB1_2 | | MCM2_2 | |
| CHK1_2 | 0.5375 | | 0.4769 | | 0.4596 | | |
| CLDN1_1 | | TMEPAI_1 | | MUC2_1 | | REG4_1 | |
| CLDN1_1 | 0.3493 | | −0.2952 | | −0.2935 | | |
| CLIC1_1 | | KLF5_1 | | VEGF_ALTSPLICE2_1 | | CAD17_1 | |
| CLIC1_1 | 0.4549 | | 0.3923 | | 0.3693 | | |
| CLTC_1 | | HNRPD_1 | | GIT1_1 | | TMSB10_1 | |
| CLTC_1 | 0.3483 | | 0.3445 | | 0.3217 | | |
| CMYC_3 | | HSPE1_1 | | NME1_3 | | TERC_2 | |
| CMYC_3 | 0.5511 | | 0.4929 | | 0.4836 | | |
| COL1A1_1 | | BGN_1 | | SPARC_1 | | TIMP2_1 | |
| COL1A1_1 | 0.8986 | | 0.8713 | | 0.8071 | | |
| COL1A2_1 | | SPARC_1 | | MMP2_2 | | COL1A1_1 | |
| COL1A2_1 | 0.8549 | | 0.7886 | | 0.7642 | | |
| CREBBP_1 | | BRAF_5 | | ITGB1_1 | | ITGAV_1 | |
| CREBBP_1 | 0.4007 | | 0.3671 | | 0.3516 | | |
| CTSB_1 | | FAP_1 | | ANXA1_2 | | CTSL_2 | |
| CTSB_1 | 0.6079 | | 0.5989 | | 0.5926 | | |
| CTSL_2 | | TP_3 | | SOD2_1 | | ITGA5_1 | |
| CTSL_2 | 0.6975 | | 0.6913 | | 0.6748 | | |
| CXCL12_1 | | BGN_1 | | CTGF_1 | | SFRP2_1 | |
| CXCL12_1 | 0.6838 | | 0.6683 | | 0.6649 | | |
| CYR61_1 | | CTGF_1 | | DUSP1_1 | | THBS1_1 | |
| CYR61_1 | 0.8028 | | 0.7338 | | 0.6623 | | |
| DLC1_1 | | TIMP2_1 | | CALD1_2 | | IGFBP5_1 | |
| DLC1_1 | 0.6783 | | 0.6707 | | 0.653 | | |
| DUSP1_1 | | CYR61_1 | | FOS_1 | | CTGF_1 | |
| DUSP1_1 | 0.7338 | | 0.7183 | | 0.6632 | | |
| E2F1_3 | | MYBL2_1 | | STK15_2 | | C20_ORF1_1 | |
| E2F1_3 | 0.548 | | 0.5117 | | 0.4871 | | |
| EFNB2_1 | | LAMC2_2 | | KLF5_1 | | SPRY2_2 | |
| EFNB2_1 | 0.4628 | | 0.426 | | 0.4161 | | |
| EGR3_1 | | NR4A1_1 | | EGR1_1 | | FOS_1 | |
| EGR3_1 | 0.5977 | | 0.5943 | | 0.5672 | | |
| EI24_1 | | H2AFZ_2 | | BAD_1 | | PRDX2_1 | |
| EI24_1 | 0.3503 | | 0.33 | | 0.3296 | | |
| ENO1_1 | | TMSB10_1 | | PKR2_1 | | RCC1_1 | |
| ENO1_1 | 0.6212 | | 0.5824 | | 0.5401 | | |
| EPAS1_1 | | TLN1_1 | | CTGF_1 | | TAGLN_3 | |
| EPAS1_1 | 0.5073 | | 0.4978 | | 0.4949 | | |
| ESPL1_3 | | BUB1_1 | | CDC2_1 | | CDC20_1 | |
| ESPL1_3 | 0.5008 | | 0.4762 | | 0.4594 | | |
| FBXO5_1 | | RRM2_1 | | CCNB1_2 | | MCM3_3 | |
| FBXO5_1 | 0.4694 | | 0.4526 | | 0.4144 | | |
| FGF18_2 | | IGFBP3_3 | | NKD_1_1 | | MADH7_1 | |
| FGF18_2 | 0.3258 | | 0.3172 | | 0.3068 | | |
| FGF2_2 | | AKAP12_2 | | CAV1_1 | | MYH11_1 | |
| FGF2_2 | 0.3964 | | 0.3882 | | 0.3828 | | |
| FOS_1 | | EGR1_1 | | NR4A1_1 | | DUSP1_1 | |
| FOS_1 | 0.7448 | | 0.7308 | | 0.7183 | | |
| FOXO3A_1 | | NOTCH1_1 | | STAT5B_2 | | G_CATENIN_1 | |
| FOXO3A_1 | 0.457 | | 0.4285 | | 0.4273 | | |
| FPGS_1 | | TGFBR2_3 | | MADH4_1 | | CKS2_2 | |
| FPGS_1 | 0.324 | | 0.3167 | | 0.304 | | |

TABLE C-continued

| | | | | | | |
|---|---|---|---|---|---|---|
| FST_1 | | BGN_1 | | CXCL12_1 | | TGFB3_1 |
| FST_1 | | | 0.4544 | | 0.4522 | | 0.4392 |
| FZD1_1 | | TIMP2_1 | | CDH11_1 | | PDGFC_3 |
| FZD1_1 | | | 0.642 | | 0.6178 | | 0.5824 |
| GJB2_1 | | SPARC_1 | | BGN_1 | | COL1A1_1 |
| GJB2_1 | | | 0.5906 | | 0.5861 | | 0.5678 |
| GPX1_2 | | THY1_1 | | IGFBP7_1 | | CAPG_1 |
| GPX1_2 | | | 0.514 | | 0.4309 | | 0.4164 |
| GRB10_1 | | RHOB_1 | | SHC1_1 | | HSPG2_1 |
| GRB10_1 | | | 0.2712 | | 0.271 | | 0.263 |
| GSK3B_2 | | VCP_1 | | NOTCH1_1 | | CAPG_1 |
| GSK3B_2 | | | 0.4936 | | 0.4861 | | 0.4596 |
| HES6_1 | | EPHB2_1 | | ANXA1_2 | | VCP_1 |
| HES6_1 | | | 0.4245 | | −0.3618 | | 0.3464 |
| HIF1A_3 | | ITGB1_1 | | SOD2_1 | | ITGA5_1 |
| HIF1A_3 | | | 0.5905 | | 0.572 | | 0.5647 |
| HLA_G_2 | | PRKCB1_1 | | VIM_3 | | MADH4_1 |
| HLA_G_2 | | | 0.183 | | 0.1662 | | 0.1158 |
| HNRPAB_3 | | CCNB1_2 | | C_MYB_MYB_OFFICIAL_1 | | HSPE1_1 |
| HNRPAB_3 | | | 0.5209 | | 0.5053 | | 0.5021 |
| HNRPD_1 | | PLK_3 | | EIF4E_1 | | TMSB10_1 |
| HNRPD_1 | | | 0.4549 | | 0.4145 | | 0.4125 |
| HOXA5_1 | | BRAF_5 | | CDC42BPA_1 | | IGFBP3_3 |
| HOXA5_1 | | | 0.3176 | | 0.3127 | | 0.3119 |
| HOXB13_1 | | PS2_2 | | MUC2_1 | | SNRPF_2 |
| HOXB13_1 | | | 0.2391 | | 0.1996 | | 0.1989 |
| HSD17B2_1 | | REG4_1 | | SEMA4B_1 | | MASPIN_2 |
| HSD17B2_1 | | | 0.5123 | | 0.4334 | | 0.4283 |
| HSPA1A_1 | | FAP_1 | | BGN_1 | | INHBA_1 |
| HSPA1A_1 | | | 0.387 | | 0.3843 | | 0.3831 |
| HSPA1B_1 | | VEGF_1 | | HSPA1A_1 | | CLTC_1 |
| HSPA1B_1 | | | 0.3855 | | 0.3521 | | −0.262 |
| HSPE1_1 | | CCNB1_2 | | CMYC_3 | | NME1_3 |
| HSPE1_1 | | | 0.5716 | | 0.5511 | | 0.5311 |
| IGFBP3_3 | | TIMP3_3 | | ANTXR1_1 | | TIMP2_1 |
| IGFBP3_3 | | | 0.5674 | | 0.5584 | | 0.5552 |
| IGFBP5_1 | | TAGLN_3 | | IGFBP7_1 | | CALD1_2 |
| IGFBP5_1 | | | 0.7829 | | 0.764 | | 0.7483 |
| IGFBP7_1 | | TAGLN_3 | | SPARC_1 | | IGFBP5_1 |
| IGFBP7_1 | | | 0.8225 | | 0.7715 | | 0.764 |
| IL6ST_3 | | AKT3_2 | | CXCL12_1 | | MCP1_1 |
| IL6ST_3 | | | 0.5231 | | 0.5025 | | 0.4968 |
| KI_67_2 | | CDC2_1 | | MAD2L1_1 | | H2AFZ_2 |
| KI_67_2 | | | 0.6905 | | 0.5992 | | 0.5801 |
| KIF22_1 | | PLK_3 | | KIFC1_1 | | H2AFZ_2 |
| KIF22_1 | | | 0.4816 | | 0.4419 | | 0.4419 |
| KIFC1_1 | | AURKB_1 | | CDC20_1 | | MCM3_3 |
| KIFC1_1 | | | 0.5327 | | 0.5047 | | 0.4837 |
| KLF5_1 | | SPRY2_2 | | LRP5_1 | | CLIC1_1 |
| KLF5_1 | | | 0.4836 | | 0.4552 | | 0.4549 |
| KLK10_3 | | KLK6_1 | | MASPIN_2 | | ANXA1_2 |
| KLK10_3 | | | 0.5431 | | 0.5107 | | 0.4727 |
| KLK6_1 | | KLK10_3 | | CDX2_3 | | ANXA1_2 |
| KLK6_1 | | | 0.5431 | | −0.3413 | | 0.3274 |
| KLRK1_2 | | CD3Z_1 | | TP_3 | | CIAP2_2 |
| KLRK1_2 | | | 0.494 | | 0.4704 | | 0.4453 |
| KRT8_3 | | SNRPF_2 | | ANXA2_2 | | GSTP_3 |
| KRT8_3 | | | 0.5452 | | 0.5068 | | 0.4753 |
| LAT_1 | | DPYD_2 | | FYN_3 | | TLN1_1 |
| LAT_1 | | | 0.5009 | | 0.4533 | | 0.4411 |
| LEF_1 | | PDGFC_3 | | IGFBP7_1 | | ANTXR1_1 |
| LEF_1 | | | 0.502 | | 0.4981 | | 0.4777 |
| LMYC_2 | | ROCK1_1 | | TLN1_1 | | FYN_3 |
| LMYC_2 | | | 0.4447 | | 0.4374 | | 0.3712 |
| LOXL2_1 | | COL1A1_1 | | SPARC_1 | | BGN_1 |
| LOXL2_1 | | | 0.7724 | | 0.7606 | | 0.7415 |
| LOX_1 | | SPARC_1 | | COL1A1_1 | | BGN_1 |
| LOX_1 | | | 0.7433 | | 0.7065 | | 0.695 |
| MAD2L1_1 | | H2AFZ_2 | | CDC2_1 | | SNRPF_2 |
| MAD2L1_1 | | | 0.6365 | | 0.6217 | | 0.6053 |
| MADH7_1 | | CDH11_1 | | MYLK_1 | | IGFBP7_1 |
| MADH7_1 | | | 0.5118 | | 0.5073 | | 0.5064 |
| MASPIN_2 | | ANXA2_2 | | KLK10_3 | | LAMA3_1 |
| MASPIN_2 | | | 0.5431 | | 0.5107 | | 0.5045 |
| MCM3_3 | | CDC2_1 | | MAD2L1_1 | | MCM2_2 |
| MCM3_3 | | | 0.496 | | 0.491 | | 0.4897 |
| MCP1_1 | | CD44S_1 | | CXCL12_1 | | ITGA5_1 |
| MCP1_1 | | | 0.6091 | | 0.6022 | | 0.5939 |
| MMP1_1 | | SOD2_1 | | ITGA5_1 | | UPA_3 |
| MMP1_1 | | | 0.4786 | | 0.4474 | | 0.439 |

TABLE C-continued

| | | | |
|---|---|---|---|
| MMP2_2 | COL1A2_1 | SPARC_1 | THBS1_1 |
| MMP2_2 | 0.7886 | 0.7229 | 0.7172 |
| MSH2_3 | HNRPAB_3 | HSPE1_1 | MCM2_2 |
| MSH2_3 | 0.4123 | 0.4117 | 0.3967 |
| MSH3_2 | PI3K_2 | BRAF_5 | RANBP2_3 |
| MSH3_2 | 0.3366 | 0.3316 | 0.3049 |
| NR4A1_1 | FOS_1 | EGR1_1 | DUSP1_1 |
| NR4A1_1 | 0.7308 | 0.6946 | 0.5993 |
| NRP1_1 | DPYD_2 | TIMP1_3 | MMP2_2 |
| NRP1_1 | 0.6582 | 0.6172 | 0.6168 |
| PDGFA_3 | TMEPAI_1 | IGFBP5_1 | TS_1 |
| PDGFA_3 | 0.3884 | 0.3655 | −0.3617 |
| PDGFC_3 | TIMP2_1 | ANTXR1_1 | SPARC_1 |
| PDGFC_3 | 0.707 | 0.6992 | 0.6961 |
| PDGFD_2 | IGF1_2 | CDH11_1 | SPARC_1 |
| PDGFD_2 | 0.4326 | 0.4256 | 0.42 |
| PDGFRA_2 | MMP2_2 | IGFBP7_1 | CDH11_1 |
| PDGFRA_2 | 0.6662 | 0.5972 | 0.5957 |
| PFN2_1 | THBS1_1 | NOTCH1_1 | MYLK_1 |
| PFN2_1 | 0.3462 | 0.3219 | 0.3037 |
| PKR2_1 | SEMA4B_1 | ANXA2_2 | ENO1_1 |
| PKR2_1 | 0.6153 | 0.5857 | 0.5824 |
| PRDX2_1 | H2AFZ_2 | MAD2L1_1 | KI_67_2 |
| PRDX2_1 | 0.4369 | 0.4257 | 0.385 |
| RAB32_1 | CD24_1 | BRAF_SNP1_6 | STMY3_3 |
| RAB32_1 | 0.4423 | −0.3921 | 0.3889 |
| RAD54L_1 | CDC20_1 | CDC2_1 | BUB1_1 |
| RAD54L_1 | 0.5213 | 0.4949 | 0.459 |
| RANBP2_3 | HNRPAB_3 | ROCK1_1 | CDC42BPA_1 |
| RANBP2_3 | 0.4152 | 0.3988 | 0.3974 |
| RCC1_1 | H2AFZ_2 | ENO1_1 | TK1_2 |
| RCC1_1 | 0.5801 | 0.5401 | 0.4709 |
| RHOB_1 | EGR1_1 | TIMP3_3 | NR4A1_1 |
| RHOB_1 | 0.5108 | 0.4698 | 0.4623 |
| ROCK2_1 | AXIN_2_3 | CDX2_3 | CDH1_INTRON_2_2 |
| ROCK2_1 | 0.4941 | 0.4547 | 0.4397 |
| RUNX1_2 | CDH11_1 | TIMP2_1 | PDGFC_3 |
| RUNX1_2 | 0.5655 | 0.5528 | 0.5419 |
| S100P_1 | PS2_2 | REG4_1 | MUC2_1 |
| S100P_1 | 0.4899 | 0.4734 | 0.4089 |
| SAT_1 | TMSB10_1 | SOD2_1 | CSEL1_1 |
| SAT_1 | 0.3895 | 0.3429 | −0.3396 |
| SEMA4B_1 | PKR2_1 | ANXA2_2 | REG4_1 |
| SEMA4B_1 | 0.6153 | 0.5244 | 0.4811 |
| SIAT4A_2 | TIMP2_1 | BGN_1 | WISP1_1 |
| SIAT4A_2 | 0.4878 | 0.4637 | 0.4428 |
| SKP2_1 | CENPF_1 | RRM1_2 | AURKB_1 |
| SKP2_1 | 0.4123 | 0.4088 | 0.3991 |
| SOD1_1 | CDC20_1 | RCC1_1 | SLC31A1_1 |
| SOD1_1 | 0.3141 | 0.3091 | 0.3038 |
| SOS1_1 | RAF1_3 | MADH4_1 | IGFBP3_3 |
| SOS1_1 | 0.3707 | 0.3331 | 0.318 |
| SPARC_1 | COL1A1_1 | BGN_1 | COL1A2_1 |
| SPARC_1 | 0.8711 | 0.8711 | 0.8549 |
| SPRY1_1 | IGFBP7_1 | NRP1_1 | THBS1_1 |
| SPRY1_1 | 0.4889 | 0.4702 | 0.47 |
| SPRY2_2 | PTCH_1 | KLF5_1 | LRP5_1 |
| SPRY2_2 | 0.4987 | 0.4836 | 0.4261 |
| STK15_2 | UBE2C_1 | CSEL1_1 | E2F1_3 |
| STK15_2 | 0.6551 | 0.6033 | 0.5117 |
| TCF_1_1 | G_CATENIN_1 | NOTCH1_1 | GSK3B_2 |
| TCF_1_1 | 0.43 | 0.4202 | 0.4085 |
| THBS1_1 | CTGF_1 | COL1A2_1 | SPARC_1 |
| THBS1_1 | 0.7694 | 0.7409 | 0.7207 |
| TIMP1_3 | SPARC_1 | BGN_1 | THBS1_1 |
| TIMP1_3 | 0.7068 | 0.6713 | 0.6534 |
| TOP2A_4 | CDC6_1 | CENPF_1 | BRCA1_2 |
| TOP2A_4 | 0.6143 | 0.4655 | 0.4571 |
| TP53BP1_2 | ITGB1_1 | RANBP2_3 | CREBBP_1 |
| TP53BP1_2 | 0.3646 | 0.3596 | 0.3439 |
| UBE2C_1 | CSEL1_1 | STK15_2 | MYBL2_1 |
| UBE2C_1 | 0.6581 | 0.6551 | 0.5006 |
| UPP1_1 | NRP1_1 | TP_3 | DPYD_2 |
| UPP1_1 | 0.3957 | 0.39 | 0.3832 |
| VCP_1 | CAPG_1 | BAD_1 | NOTCH1_1 |
| VCP_1 | 0.5823 | 0.5384 | 0.4991 |
| VDAC2_1 | HDAC1_1 | SLC25A3_2 | HNRPAB_3 |
| VDAC2_1 | 0.5109 | 0.4867 | 0.4316 |

TABLE C-continued

| Variable | out4 | out5 | out6 |
|---|---|---|---|
| AMFR_1 | VEGFB_1 | GSK3B_2 | THY1_1 |
| AMFR_1 | 0.2993 | 0.2949 | 0.2857 |
| ANXA1_2 | FAP_1 | CTHRC1_1 | CDX2_3 |
| ANXA1_2 | 0.516 | 0.5157 | −0.5141 |
| APC_4 | CSF1_1 | HIF1A_3 | DAPK1_3 |
| APC_4 | 0.3599 | 0.3591 | 0.3531 |
| AURKB_1 | TS_1 | CENPF_1 | DHFR_2 |
| AURKB_1 | 0.4854 | 0.461 | 0.4445 |
| AXIN_2_3 | EPHB2_1 | PTCH_1 | ROCK2_1 |
| AXIN_2_3 | 0.56 | 0.5044 | 0.4941 |
| BGN_1 | FAP_1 | ANTXR1_1 | TGFB3_1 |
| BGN_1 | 0.8177 | 0.8159 | 0.8147 |
| BIK_1 | MUC2_1 | REG4_1 | MUC1_2 |
| BIK_1 | 0.3079 | 0.2971 | 0.2771 |
| BRAF_5 | CDC42BPA_1 | MYLK_1 | AKT3_2 |
| BRAF_5 | 0.3855 | 0.3576 | 0.3574 |
| BRAF_SNP1_6 | RAB32_1 | CRIPTO_TDGF1_OFFICIAL_1 | TS_1 |
| BRAF_SNP1_6 | −0.3921 | −0.3901 | 0.378 |
| BRCA2_2 | C_MYB_MYB_OFFICIAL_1 | MYBL2_1 | CDCA7_V2_1 |
| BRCA2_2 | 0.2432 | 0.2361 | 0.2332 |
| BUB1_1 | H2AFZ_2 | MAD2L1_1 | LMNB1_1 |
| BUB1_1 | 0.5328 | 0.5271 | 0.5245 |
| B_CATENIN_3 | TERC_2 | NOTCH1_1 | GSK3B_2 |
| B_CATENIN_3 | 0.4227 | 0.4191 | 0.4076 |
| C20ORF126_1 | MUC1_2 | EGLN3_1 | PKR2_1 |
| C20ORF126_1 | −0.4702 | −0.4675 | −0.4551 |
| C20_ORF1_1 | STK15_2 | E2F1_3 | UBE2C_1 |
| C20_ORF1_1 | 0.4949 | 0.4871 | 0.4835 |
| CALD1_2 | TIMP2_1 | MYLK_1 | PDGFC_3 |
| CALD1_2 | 0.691 | 0.6846 | 0.6822 |
| CASP9_1 | SPRY1_1 | RHOC_1 | IGFBP7_1 |
| CASP9_1 | 0.2115 | 0.2078 | 0.2067 |
| CCNE2_2 | TIMP2_1 | CCNA2_1 | ANTXR1_1 |
| CCNE2_2 | −0.3627 | 0.3526 | −0.3382 |
| CCNE2_VARIANT_1_1 | HSPE1_1 | CCNB1_2 | FBXO5_1 |
| CCNE2_VARIANT_1_1 | 0.3882 | 0.3826 | 0.3627 |
| CD44E_1 | SNRPF_2 | RPS13_1 | HSPE1_1 |
| CD44E_1 | 0.4171 | 0.413 | 0.4043 |
| CD44S_1 | UPA_3 | TLN1_1 | THBS1_1 |
| CD44S_1 | 0.5919 | 0.5851 | 0.5824 |
| CD44V6_1 | MUC1_2 | SNRPF_2 | HNRPAB_3 |
| CD44V6_1 | 0.3631 | 0.3617 | 0.3512 |
| CD68_2 | TP_3 | DPYD_2 | CD44S_1 |
| CD68_2 | 0.538 | 0.5347 | 0.534 |
| CDC2_1 | H2AFZ_2 | CDC20_1 | LMNB1_1 |
| CDC2_1 | 0.5658 | 0.5426 | 0.5375 |
| CDC4_1 | RBX1_1 | CYR61_1 | ITGB1_1 |
| CDC4_1 | 0.2745 | 0.2745 | 0.2741 |
| CDH11_1 | CALD1_2 | TAGLN_3 | IGFBP5_1 |
| CDH11_1 | 0.7339 | 0.7338 | 0.7319 |
| CDX2_3 | EPHB2_1 | C_MYB_MYB_OFFICIAL_1 | PKR2_1 |
| CDX2_3 | 0.5617 | 0.5296 | −0.5224 |
| CENPA_1 | C20_ORF1_1 | CDC2_1 | AURKB_1 |
| CENPA_1 | 0.4213 | 0.3996 | 0.3884 |
| CENPF_1 | NEK2_1 | BUB1_1 | PLK_3 |
| CENPF_1 | 0.4607 | 0.4578 | 0.4548 |
| CHFR_1 | DLC1_1 | CALD1_2 | PDGFC_3 |
| CHFR_1 | 0.3762 | 0.3762 | 0.3703 |
| CHK1_2 | MCM6_3 | RRM1_2 | CKS2_2 |
| CHK1_2 | 0.4522 | 0.4487 | 0.4419 |
| CLDN1_1 | ATP5E_1 | CRIPTO_TDGF1_OFFICIAL_1 | ATP5A1_1 |
| CLDN1_1 | 0.2804 | 0.2714 | −0.2698 |
| CLIC1_1 | G_CATENIN_1 | CLAUDIN_4_2 | VEGF_ALTSPLICE_1 |
| CLIC1_1 | 0.3686 | 0.3617 | 0.3464 |
| CLTC_1 | HES6_1 | G_CATENIN_1 | NME1_3 |
| CLTC_1 | 0.2959 | 0.2938 | 0.2763 |
| CMYC_3 | EREG_1 | AREG_2 | NOTCH1_1 |
| CMYC_3 | 0.4652 | 0.4599 | 0.4592 |
| COL1A1_1 | FAP_1 | ANTXR1_1 | LOXL2_1 |
| COL1A1_1 | 0.7833 | 0.7796 | 0.7724 |
| COL1A2_1 | THBS1_1 | BGN_1 | CDH11_1 |
| COL1A2_1 | 0.7409 | 0.7368 | 0.7272 |
| CREBBP_1 | TP53BP1_2 | RAF1_3 | FZD1_1 |
| CREBBP_1 | 0.3439 | 0.3335 | 0.3316 |
| CTSB_1 | CTHRC1_1 | CXCR4_3 | CD68_2 |
| CTSB_1 | 0.5907 | 0.5813 | 0.579 |
| CTSL_2 | UPA_3 | TIMP1_3 | THBS1_1 |
| CTSL_2 | 0.6558 | 0.6448 | 0.636 |

TABLE C-continued

| | | | |
|---|---|---|---|
| CXCL12_1 | TIMP2_1 | TGFB3_1 | VIM_3 |
| CXCL12_1 | 0.6334 | 0.6254 | 0.6212 |
| CYR61_1 | PAI1_3 | COL1A2_1 | INHBA_1 |
| CYR61_1 | 0.6477 | 0.6272 | 0.6257 |
| DLC1_1 | TGFB3_1 | BGN_1 | ANTXR1_1 |
| DLC1_1 | 0.6465 | 0.6399 | 0.6378 |
| DUSP1_1 | PAI1_3 | EGR1_1 | NR4A1_1 |
| DUSP1_1 | 0.6545 | 0.6357 | 0.5993 |
| E2F1_3 | CSEL1_1 | CMYC_3 | UBE2C_1 |
| E2F1_3 | 0.4799 | 0.4391 | 0.4385 |
| EFNB2_1 | TMEPAI_1 | MASPIN_2 | RUNX1_2 |
| EFNB2_1 | 0.3689 | 0.3621 | 0.3558 |
| EGR3_1 | DUSP1_1 | CYR61_1 | HB_EGF_1 |
| EGR3_1 | 0.5184 | 0.4565 | 0.4275 |
| EI24_1 | KI_67_2 | UMPS_2 | MAD2L1_1 |
| EI24_1 | 0.3137 | 0.3104 | 0.309 |
| ENO1_1 | CDC20_1 | TK1_2 | H2AFZ_2 |
| ENO1_1 | 0.5181 | 0.5122 | 0.5104 |
| EPAS1_1 | DLC1_1 | MYLK_1 | CDH11_1 |
| EPAS1_1 | 0.4927 | 0.4924 | 0.4886 |
| ESPL1_3 | KI_67_2 | LMNB1_1 | PLK_3 |
| ESPL1_3 | 0.4577 | 0.457 | 0.4453 |
| FBXO5_1 | RBX1_1 | CENPF_1 | KIFC1_1 |
| FBXO5_1 | 0.3819 | 0.3819 | 0.3681 |
| FGF18_2 | LEF_1 | TGFB3_1 | SFRP2_1 |
| FGF18_2 | 0.3058 | 0.2956 | 0.2951 |
| FGF2_2 | AKT3_2 | CRYAB_1 | TAGLN_3 |
| FGF2_2 | 0.3678 | 0.3619 | 0.3568 |
| FOS_1 | CYR61_1 | EGR3_1 | HB_EGF_1 |
| FOS_1 | 0.5673 | 0.5672 | 0.5097 |
| FOXO3A_1 | MYLK_1 | MMP2_2 | ATP5E_1 |
| FOXO3A_1 | 0.423 | 0.4161 | 0.412 |
| FPGS_1 | HSPE1_1 | SOS1_1 | LEF_1 |
| FPGS_1 | −0.2981 | 0.2922 | 0.29 |
| FST_1 | SFRP2_1 | DLC1_1 | TIMP2_1 |
| FST_1 | 0.4331 | 0.4234 | 0.4116 |
| FZD1_1 | SPARC_1 | IGFBP7_1 | MMP2_2 |
| FZD1_1 | 0.5755 | 0.5718 | 0.5708 |
| GJB2_1 | LOX_1 | TGFB3_1 | INHBA_1 |
| GJB2_1 | 0.5664 | 0.5082 | 0.5023 |
| GPX1_2 | PGK1_1 | KLF6_1 | BGN_1 |
| GPX1_2 | −0.4123 | 0.3963 | 0.3957 |
| GRB10_1 | TGFBR2_3 | TK1_2 | RRM2_1 |
| GRB10_1 | 0.2471 | −0.2301 | −0.2298 |
| GSK3B_2 | BAD_1 | IGFBP7_1 | TCF_1_1 |
| GSK3B_2 | 0.4537 | 0.4189 | 0.4085 |
| HES6_1 | CIAP2_2 | GSK3B_2 | CRIPTO_TDGF1_OFFICIAL_1 |
| HES6_1 | −0.3391 | 0.3363 | 0.3251 |
| HIF1A_3 | MCP1_1 | CSF1_1 | MMP2_2 |
| HIF1A_3 | 0.5464 | 0.5254 | 0.5156 |
| HLA_G_2 | DPYD_2 | CD3Z_1 | RANBP2_3 |
| HLA_G_2 | 0.1155 | 0.1145 | −0.1102 |
| HNRPAB_3 | CCNA2_1 | RRM2_1 | SLC25A3_2 |
| HNRPAB_3 | 0.4855 | 0.4497 | 0.4401 |
| HNRPD_1 | GIT1_1 | FASN_1 | ENO1_1 |
| HNRPD_1 | 0.3984 | 0.3958 | 0.3931 |
| HOXA5_1 | TGFBR2_3 | RAF1_3 | CREBBP_1 |
| HOXA5_1 | 0.307 | 0.3009 | 0.2981 |
| HOXB13_1 | REG4_1 | CLDN7_2 | LGALS3_1 |
| HOXB13_1 | 0.1949 | 0.1847 | 0.1609 |
| HSD17B2_1 | ANXA2_2 | PS2_2 | DAPK1_3 |
| HSD17B2_1 | 0.4182 | 0.4129 | 0.4045 |
| HSPA1A_1 | UPA_3 | CTHRC1_1 | GADD45B_1 |
| HSPA1A_1 | 0.3805 | 0.3773 | 0.3714 |
| HSPA1B_1 | UBE2C_1 | MYH11_1 | MUC2_1 |
| HSPA1B_1 | 0.2604 | −0.2511 | −0.2434 |
| HSPE1_1 | SNRPF_2 | HNRPAB_3 | RRM2_1 |
| HSPE1_1 | 0.5223 | 0.5021 | 0.4812 |
| IGFBP3_3 | SFRP4_1 | PDGFC_3 | FAP_1 |
| IGFBP3_3 | 0.5548 | 0.5123 | 0.5112 |
| IGFBP5_1 | CDH11_1 | TIMP2_1 | SPARC_1 |
| IGFBP5_1 | 0.7319 | 0.6893 | 0.6781 |
| IGFBP7_1 | CDH11_1 | THY1_1 | HSPG2_1 |
| IGFBP7_1 | 0.7587 | 0.7428 | 0.7246 |
| IL6ST_3 | TIMP2_1 | DLC1_1 | ITGB3_1 |
| IL6ST_3 | 0.4886 | 0.4739 | 0.4683 |
| KI_67_2 | BUB1_1 | CDC20_1 | SURV_2 |
| KI_67_2 | 0.5398 | 0.5187 | 0.5127 |
| KIF22_1 | KI_67_2 | TUFM_1 | MCM3_3 |
| KIF22_1 | 0.4417 | 0.4387 | 0.4297 |

TABLE C-continued

| | | | |
|---|---|---|---|
| KIFC1_1 | LMNB1_1 | PLK_3 | KIF22_1 |
| KIFC1_1 | 0.4831 | 0.4829 | 0.4811 |
| KLF5_1 | PI3K_2 | EFNB2_1 | CAD17_1 |
| KLF5_1 | 0.436 | 0.426 | 0.424 |
| KLK10_3 | PKR2_1 | ANXA2_2 | SEMA4B_1 |
| KLK10_3 | 0.4679 | 0.436 | 0.3896 |
| KLK6_1 | S100A4_1 | C_MYB_MYB_OFFICIAL_1 | PKR2_1 |
| KLK6_1 | 0.307 | −0.2976 | 0.2764 |
| KLRK1_2 | GBP2_2 | CSF1_1 | PRKCB1_1 |
| KLRK1_2 | 0.442 | 0.4295 | 0.4276 |
| KRT8_3 | MRP3_1 | LGALS3_1 | BAD_1 |
| KRT8_3 | 0.4717 | 0.4712 | 0.4431 |
| LAT_1 | TP_3 | NRP2_2 | CD18_2 |
| LAT_1 | 0.4197 | 0.4096 | 0.4093 |
| LEF_1 | SFRP4_1 | IGFBP3_3 | FZD1_1 |
| LEF_1 | 0.4739 | 0.4674 | 0.4645 |
| LMYC_2 | VIM_3 | RANBP2_3 | VEGF_ALTSPLICE2_1 |
| LMYC_2 | 0.3681 | 0.3586 | 0.3433 |
| LOXL2_1 | COL1A2_1 | TIMP2_1 | ANTXR1_1 |
| LOXL2_1 | 0.7248 | 0.7174 | 0.6829 |
| LOX_1 | COL1A2_1 | INHBA_1 | LOXL2_1 |
| LOX_1 | 0.62 | 0.604 | 0.5981 |
| MAD2L1_1 | TK1_2 | KI_67_2 | SURV_2 |
| MAD2L1_1 | 0.6019 | 0.5992 | 0.5841 |
| MADH7_1 | ID3_2 | CALD1_2 | TLN1_1 |
| MADH7_1 | 0.5055 | 0.5025 | 0.5 |
| MASPIN_2 | PKR2_1 | REG4_1 | SEMA4B_1 |
| MASPIN_2 | 0.4999 | 0.4829 | 0.4485 |
| MCM3_3 | KIFC1_1 | PCNA_2 | H2AFZ_2 |
| MCM3_3 | 0.4837 | 0.45 | 0.4488 |
| MCP1_1 | CTSL_2 | TIMP1_3 | FAP_1 |
| MCP1_1 | 0.5937 | 0.5922 | 0.5901 |
| MMP1_1 | CTSL_2 | HIF1A_3 | MMP2_2 |
| MMP1_1 | 0.4101 | 0.4086 | 0.4036 |
| MMP2_2 | CDH11_1 | ITGA5_1 | TAGLN_3 |
| MMP2_2 | 0.7019 | 0.6969 | 0.6663 |
| MSH2_3 | CHK1_2 | RANBP2_3 | CCNA2_1 |
| MSH2_3 | 0.3787 | 0.3732 | 0.3662 |
| MSH3_2 | CDC42BPA_1 | CAD17_1 | VEGF_ALTSPLICE2_1 |
| MSH3_2 | 0.2956 | 0.2908 | 0.2885 |
| NR4A1_1 | EGR3_1 | HB_EGF_1 | CYR61_1 |
| NR4A1_1 | 0.5977 | 0.5041 | 0.4881 |
| NRP1_1 | CTSL_2 | SPARC_1 | VIM_3 |
| NRP1_1 | 0.6068 | 0.5989 | 0.5925 |
| PDGFA_3 | ANTXR1_1 | IGFBP7_1 | PTCH_1 |
| PDGFA_3 | 0.3533 | 0.3519 | 0.3457 |
| PDGFC_3 | CDH11_1 | CALD1_2 | BGN_1 |
| PDGFC_3 | 0.6845 | 0.6822 | 0.6788 |
| PDGFD_2 | PDGFRA_2 | IGFBP7_1 | PDGFC_3 |
| PDGFD_2 | 0.4078 | 0.4048 | 0.402 |
| PDGFRA_2 | MYLK_1 | TAGLN_3 | IGFBP5_1 |
| PDGFRA_2 | 0.5934 | 0.5926 | 0.5849 |
| PFN2_1 | MMP2_2 | NME1_3 | VIM_3 |
| PFN2_1 | 0.3005 | 0.2977 | 0.2945 |
| PKR2_1 | ANXA1_2 | CDX2_3 | TMSB10_1 |
| PKR2_1 | 0.5649 | −0.5224 | 0.5159 |
| PRDX2_1 | CDC2_1 | ATP5A1_1 | CLDN7_2 |
| PRDX2_1 | 0.358 | 0.3566 | 0.3468 |
| RAB32_1 | NOTCH1_1 | PDGFRA_2 | MYLK_1 |
| RAB32_1 | 0.3762 | 0.3749 | 0.3703 |
| RAD54L_1 | KIFC1_1 | KI_67_2 | H2AFZ_2 |
| RAD54L_1 | 0.4585 | 0.458 | 0.4491 |
| RANBP2_3 | MSH2_3 | TFF3_3 | ODC1_3 |
| RANBP2_3 | 0.3732 | 0.3711 | 0.3704 |
| RCC1_1 | SURV_2 | NME1_3 | CDC2_1 |
| RCC1_1 | 0.4553 | 0.4427 | 0.4362 |
| RHOB_1 | FOS_1 | TGFBR2_3 | DUSP1_1 |
| RHOB_1 | 0.4315 | 0.4192 | 0.4061 |
| ROCK2_1 | TGFBR2_3 | CRIPTO_TDGF1_OFFICIAL_1 | PTCH_1 |
| ROCK2_1 | 0.4064 | 0.398 | 0.3971 |
| RUNX1_2 | ANTXR1_1 | BGN_1 | CALD1_2 |
| RUNX1_2 | 0.5273 | 0.5237 | 0.5186 |
| S100P_1 | TFF3_3 | F3_1 | MASPIN_2 |
| S100P_1 | 0.3989 | 0.371 | 0.3674 |
| SAT_1 | UPA_3 | TP_3 | LOX_1 |
| SAT_1 | 0.3315 | 0.3209 | 0.3066 |
| SEMA4B_1 | F3_1 | MASPIN_2 | MUC1_2 |
| SEMA4B_1 | 0.4508 | 0.4485 | 0.4399 |
| SIAT4A_2 | COL1A1_1 | GADD45B_1 | SPARC_1 |
| SIAT4A_2 | 0.4426 | 0.4426 | 0.4387 |

TABLE C-continued

| | | | |
|---|---|---|---|
| SKP2_1 | CCNA2_1 | CHK1_2 | MCM2_2 |
| SKP2_1 | 0.3798 | 0.3782 | 0.3769 |
| SOD1_1 | ENO1_1 | DHFR_2 | HSPA8_1 |
| SOD1_1 | 0.2791 | 0.2756 | 0.27 |
| SOS1_1 | AKT3_2 | IL6ST_3 | MAD2L1_1 |
| SOS1_1 | 0.2945 | 0.2941 | −0.2938 |
| SPARC_1 | TIMP2_1 | CDH11_1 | INHBA_1 |
| SPARC_1 | 0.7967 | 0.7831 | 0.774 |
| SPRY1_1 | TAGLN_3 | CTGF_1 | MMP2_2 |
| SPRY1_1 | 0.4639 | 0.4627 | 0.461 |
| SPRY2_2 | EFNB2_1 | NOTCH1_1 | B_CATENIN_3 |
| SPRY2_2 | 0.4161 | 0.3783 | 0.3467 |
| STK15_2 | C20_ORF1_1 | CDC2_1 | MYBL2_1 |
| STK15_2 | 0.4949 | 0.4653 | 0.4622 |
| TCF_1_1 | PTCH_1 | EPHB2_1 | CDX2_3 |
| TCF_1_1 | 0.4079 | 0.3856 | 0.384 |
| THBS1_1 | MMP2_2 | ITGA5_1 | PAI1_3 |
| THBS1_1 | 0.7172 | 0.7058 | 0.6802 |
| TIMP1_3 | COL1A2_1 | CDH11_1 | CTSL_2 |
| TIMP1_3 | 0.6518 | 0.6452 | 0.6448 |
| TOP2A_4 | NME1_3 | SURV_2 | KIFC1_1 |
| TOP2A_4 | 0.4544 | 0.4375 | 0.429 |
| TP53BP1_2 | PI3K_2 | BRAF_5 | TP53BP2_2 |
| TP53BP1_2 | 0.3385 | 0.336 | 0.3354 |
| UBE2C_1 | C20_ORF1_1 | E2F1_3 | MCM2_2 |
| UBE2C_1 | 0.4835 | 0.4385 | 0.411 |
| UPP1_1 | SOD2_1 | KRT8_3 | CTSL_2 |
| UPP1_1 | 0.3824 | 0.381 | 0.3658 |
| VCP_1 | GSK3B_2 | H2AFZ_2 | MAD2L1_1 |
| VCP_1 | 0.4936 | 0.4724 | 0.4564 |
| VDAC2_1 | PKR2_1 | TS_1 | SEMA4B_1 |
| VDAC2_1 | 0.4196 | 0.3748 | 0.3683 |

| Variable | out7 | out8 | out9 |
|---|---|---|---|
| AMFR_1 | VCP_1 | TUFM_1 | LRP5_1 |
| AMFR_1 | 0.2829 | 0.2788 | 0.2784 |
| ANXA1_2 | TIMP2_1 | CXCL12_1 | BGN_1 |
| ANXA1_2 | 0.5124 | 0.5031 | 0.4987 |
| APC_4 | MADH2_1 | ITGAV_1 | FYN_3 |
| APC_4 | 0.3455 | 0.3406 | 0.3388 |
| AURKB_1 | BUB1_1 | LMNB1_1 | ESPL1_3 |
| AURKB_1 | 0.4355 | 0.4337 | 0.4332 |
| AXIN_2_3 | TP_3 | BRAF_SNP1_6 | CAD17_1 |
| AXIN_2_3 | −0.4647 | −0.4564 | 0.4454 |
| BGN_1 | SFRP2_1 | INHBA_1 | WISP1_1 |
| BGN_1 | 0.811 | 0.7854 | 0.7682 |
| BIK_1 | SLC25A3_2 | ATP5A1_1 | VDAC2_1 |
| BIK_1 | 0.2713 | 0.2701 | 0.255 |
| BRAF_5 | RAF1_3 | RANBP2_3 | TGFBR2_3 |
| BRAF_5 | 0.3497 | 0.3476 | 0.3449 |
| BRAF_SNP1_6 | HSD17B2_1 | PKR2_1 | APG_1_1 |
| BRAF_SNP1_6 | 0.3757 | 0.372 | 0.3705 |
| BRCA2_2 | CHK1_2 | CLDN1_1 | CAPG_1 |
| BRCA2_2 | 0.2303 | 0.2196 | −0.2151 |
| BUB1_1 | ESPL1_3 | NEK2_1 | SURV_2 |
| BUB1_1 | 0.5008 | 0.4929 | 0.4923 |
| B_CATENIN_3 | KLF5_1 | VEGFB_1 | IGFBP7_1 |
| B_CATENIN_3 | 0.38 | 0.3684 | 0.3679 |
| C20ORF126_1 | EREG_1 | REG4_1 | TMSB10_1 |
| C20ORF126_1 | 0.4485 | −0.4439 | −0.4296 |
| C20_ORF1_1 | CSEL1_1 | CENPA_1 | DPYD_2 |
| C20_ORF1_1 | 0.448 | 0.4213 | −0.4108 |
| CALD1_2 | DLC1_1 | ANTXR1_1 | IGFBP7_1 |
| CALD1_2 | 0.6707 | 0.6524 | 0.6494 |
| CASP9_1 | PDGFRA_2 | PDGFA_3 | BAD_1 |
| CASP9_1 | 0.2051 | 0.2035 | 0.2033 |
| CCNE2_2 | MCM6_3 | THY1_1 | CKS2_2 |
| CCNE2_2 | 0.3367 | −0.3216 | 0.2999 |
| CCNE2_VARIANT_1_1 | RBX1_1 | SNRPF_2 | CHK1_2 |
| CCNE2_VARIANT_1_1 | 0.3448 | 0.3294 | 0.3273 |
| CD44E_1 | PI3K_2 | RBX1_1 | LGALS3_1 |
| CD44E_1 | 0.3992 | 0.3989 | 0.3888 |
| CD44S_1 | VIM_3 | ITGA5_1 | CTGF_1 |
| CD44S_1 | 0.5817 | 0.5815 | 0.5759 |
| CD44V6_1 | ENO1_1 | DAPK1_3 | TMSB10_1 |
| CD44V6_1 | 0.3432 | 0.3388 | 0.338 |
| CD68_2 | SOD2_1 | NRP1_1 | CSF1_1 |
| CD68_2 | 0.5168 | 0.5045 | 0.4849 |
| CDC2_1 | CCNB1_2 | SURV_2 | MCM3_3 |

TABLE C-continued

| | | | |
|---|---|---|---|
| CDC2_1 | 0.5255 | 0.5161 | 0.496 |
| CDC4_1 | AKT3_2 | IL6ST_3 | TP53BP2_2 |
| CDC4_1 | 0.2707 | 0.2704 | 0.2692 |
| CDH11_1 | COL1A2_1 | BGN_1 | MMP2_2 |
| CDH11_1 | 0.7272 | 0.7265 | 0.7019 |
| CDX2_3 | ANXA1_2 | PTCH_1 | ST14_1 |
| CDX2_3 | −0.5141 | 0.4989 | 0.4834 |
| CENPA_1 | CDC20_1 | LMNB1_1 | ESPL1_3 |
| CENPA_1 | 0.3792 | 0.3764 | 0.3671 |
| CENPF_1 | ESPL1_3 | RRM1_2 | CDC20_1 |
| CENPF_1 | 0.4445 | 0.44 | 0.4269 |
| CHFR_1 | IGFBP5_1 | MYH11_1 | MADH7_1 |
| CHFR_1 | 0.3644 | 0.3625 | 0.3602 |
| CHK1_2 | KIFC1_1 | AURKB_1 | CDC20_1 |
| CHK1_2 | 0.4332 | 0.4285 | 0.4206 |
| CLDN1_1 | MGAT5_1 | PS2_2 | TS_1 |
| CLDN1_1 | 0.269 | −0.253 | −0.2498 |
| CLIC1_1 | MGAT5_1 | ST14_1 | CDCA7_V2_1 |
| CLIC1_1 | 0.3365 | 0.3324 | 0.3232 |
| CLTC_1 | CSEL1_1 | SBA2_1 | MADH2_1 |
| CLTC_1 | −0.2755 | 0.2755 | 0.2714 |
| CMYC_3 | MYBL2_1 | CSEL1_1 | C_SRC_1 |
| CMYC_3 | 0.4543 | 0.4539 | 0.4449 |
| COL1A1_1 | COL1A2_1 | CTHRC1_1 | TGFB3_1 |
| COL1A1_1 | 0.7642 | 0.7496 | 0.7491 |
| COL1A2_1 | LOXL2_1 | ITGA5_1 | CTHRC1_1 |
| COL1A2_1 | 0.7248 | 0.7243 | 0.7112 |
| CREBBP_1 | GCNT1_1 | RUNX1_2 | MYH11_1 |
| CREBBP_1 | 0.32 | 0.3194 | 0.3181 |
| CTSB_1 | BGN_1 | COL1A1_1 | UPA_3 |
| CTSB_1 | 0.578 | 0.5594 | 0.5514 |
| CTSL_2 | PAI1_3 | COL1A2_1 | DPYD_2 |
| CTSL_2 | 0.6296 | 0.6152 | 0.6151 |
| CXCL12_1 | COL1A1_1 | SPARC_1 | CYR61_1 |
| CXCL12_1 | 0.6206 | 0.6173 | 0.6149 |
| CYR61_1 | CXCL12_1 | CTHRC1_1 | VIM_3 |
| CYR61_1 | 0.6149 | 0.5918 | 0.576 |
| DLC1_1 | TAGLN_3 | THY1_1 | HSPG2_1 |
| DLC1_1 | 0.6075 | 0.6065 | 0.6047 |
| DUSP1_1 | GADD45B_1 | THBS1_1 | CXCL12_1 |
| DUSP1_1 | 0.5877 | 0.5827 | 0.5262 |
| E2F1_3 | C20ORF126_1 | ATP5E_1 | BRCA1_2 |
| E2F1_3 | 0.4259 | 0.4253 | 0.4185 |
| EFNB2_1 | STMY3_3 | EMP1_1 | GSTP_3 |
| EFNB2_1 | 0.3511 | 0.3446 | 0.3387 |
| EGR3_1 | PLK3_1 | RHOB_1 | PAI1_3 |
| EGR3_1 | 0.3879 | 0.3764 | 0.3616 |
| EI24_1 | HSPA8_1 | VCP_1 | SNRPF_2 |
| EI24_1 | 0.3061 | 0.3054 | 0.3044 |
| ENO1_1 | RRM2_1 | BUB1_1 | TGFBR2_3 |
| ENO1_1 | 0.445 | 0.4408 | −0.4332 |
| EPAS1_1 | IGFBP7_1 | TIMP2_1 | HSPG2_1 |
| EPAS1_1 | 0.4845 | 0.4802 | 0.4794 |
| ESPL1_3 | CENPF_1 | AURKB_1 | SURV_2 |
| ESPL1_3 | 0.4445 | 0.4332 | 0.426 |
| FBXO5_1 | CCNE2_VARIANT_1_1 | HSPE1_1 | KI_67_2 |
| FBXO5_1 | 0.3627 | 0.3551 | 0.3535 |
| FGF18_2 | UBB_1 | TIMP3_3 | CDC42BPA_1 |
| FGF18_2 | −0.2889 | 0.2824 | 0.2804 |
| FGF2_2 | MYLK_1 | ITGB3_1 | IL6ST_3 |
| FGF2_2 | 0.3438 | 0.3421 | 0.3369 |
| FOS_1 | CTGF_1 | PAI1_3 | C8ORF4_1 |
| FOS_1 | 0.478 | 0.4715 | 0.4526 |
| FOXO3A_1 | C_SRC_1 | GSK3B_2 | PTCH_1 |
| FOXO3A_1 | 0.4066 | 0.4026 | 0.4004 |
| FPGS_1 | MADH2_1 | VDAC2_1 | HOXB7_1 |
| FPGS_1 | 0.2809 | 0.2803 | 0.276 |
| FST_1 | FAP_1 | COL1A1_1 | WISP1_1 |
| FST_1 | 0.4052 | 0.403 | 0.4017 |
| FZD1_1 | ANTXR1_1 | NRP2_2 | COL1A2_1 |
| FZD1_1 | 0.5671 | 0.5627 | 0.5598 |
| GJB2_1 | TIMP1_3 | WISP1_1 | TIMP2_1 |
| GJB2_1 | 0.4963 | 0.4892 | 0.4817 |
| GPX1_2 | HNRPAB_3 | HSPG2_1 | SPARC_1 |
| GPX1_2 | −0.3907 | 0.3909 | 0.3899 |
| GRB10_1 | MAD2L1_1 | CCNB1_2 | TIMP2_1 |
| GRB10_1 | −0.2283 | −0.2247 | 0.2221 |
| GSK3B_2 | B_CATENIN_3 | G_CATENIN_1 | NEDD8_2 |
| GSK3B_2 | 0.4076 | 0.4072 | −0.404 |
| HES6_1 | CTSB_1 | KLK10_3 | CDX2_3 |

TABLE C-continued

| Col 1 | Col 2 | Col 3 | Col 4 |
|---|---|---|---|
| HES6_1 | -0.324 | -0.3229 | 0.3191 |
| HIF1A_3 | CTSL_2 | CD44S_1 | CTGF_1 |
| HIF1A_3 | 0.5147 | 0.5121 | 0.5057 |
| HLA_G_2 | WNT2_1 | VEGFB_1 | SLC31A1_1 |
| HLA_G_2 | 0.1098 | 0.1052 | 0.1046 |
| HNRPAB_3 | VDAC2_1 | RBX1_1 | CD44E_1 |
| HNRPAB_3 | 0.4316 | 0.4314 | 0.4304 |
| HNRPD_1 | UBE2M_2 | RCC1_1 | H2AFZ_2 |
| HNRPD_1 | 0.3866 | 0.3768 | 0.3749 |
| HOXA5_1 | HOXB7_1 | TK1_2 | IL6ST_3 |
| HOXA5_1 | 0.2972 | -0.2779 | 0.2753 |
| HOXB13_1 | C_SRC_1 | CYP1B1_3 | NME1_3 |
| HOXB13_1 | 0.1596 | -0.1595 | 0.1574 |
| HSD17B2_1 | CYP3A4_2 | BRAF_SNP1_6 | MRP3_1 |
| HSD17B2_1 | 0.3929 | 0.3757 | 0.3732 |
| HSPA1A_1 | CYP1B1_3 | COL1A1_1 | ANXA1_2 |
| HSPA1A_1 | 0.3705 | 0.3639 | 0.3625 |
| HSPA1B_1 | MYLK_1 | STK15_2 | CKS2_2 |
| HSPA1B_1 | -0.2301 | 0.2288 | 0.2066 |
| HSPE1_1 | RBX1_1 | ODC1_3 | MAD2L1_1 |
| HSPE1_1 | 0.4767 | 0.4647 | 0.458 |
| IGFBP3_3 | BGN_1 | FZD1_1 | CTHRC1_1 |
| IGFBP3_3 | 0.5055 | 0.5019 | 0.4871 |
| IGFBP5_1 | MYLK_1 | DLC1_1 | TIMP1_3 |
| IGFBP5_1 | 0.6532 | 0.653 | 0.6403 |
| IGFBP7_1 | TIMP2_1 | SFRP4_1 | ANTXR1_1 |
| IGFBP7_1 | 0.7139 | 0.6558 | 0.6541 |
| IL6ST_3 | VIM_3 | EPAS1_1 | ITGB1_1 |
| IL6ST_3 | 0.466 | 0.4652 | 0.4617 |
| KI_67_2 | TK1_2 | NEK2_1 | LMNB1_1 |
| KI_67_2 | 0.5071 | 0.5055 | 0.4996 |
| KIF22_1 | RAD54L_1 | NEK2_1 | CDC2_1 |
| KIF22_1 | 0.4178 | 0.4138 | 0.4112 |
| KIFC1_1 | CDC2_1 | CENPF_1 | KI_67_2 |
| KIFC1_1 | 0.4715 | 0.4649 | 0.4614 |
| KLF5_1 | NOTCH1_1 | C_SRC_1 | CLAUDIN_4_2 |
| KLF5_1 | 0.4235 | 0.4121 | 0.4102 |
| KLK10_3 | CDX2_3 | CRIPTO_TDGF1_OFFICIAL_1 | LAMA3_1 |
| KLK10_3 | -0.3895 | -0.3884 | 0.3542 |
| KLK6_1 | LAMA3_1 | ANXA2_2 | MMP7_1 |
| KLK6_1 | 0.2714 | 0.2614 | 0.2568 |
| KLRK1_2 | CTSB_1 | CXCR4_3 | CD18_2 |
| KLRK1_2 | 0.4222 | 0.4214 | 0.4121 |
| KRT8_3 | MAD2L1_1 | CAPG_1 | ITGB4_2 |
| KRT8_3 | 0.4427 | 0.4395 | 0.4176 |
| LAT_1 | NRP1_1 | IGFBP7_1 | VIM_3 |
| LAT_1 | 0.4074 | 0.4042 | 0.389 |
| LEF_1 | PTCH_1 | TIMP2_1 | CDH11_1 |
| LEF_1 | 0.4637 | 0.4554 | 0.4514 |
| LMYC_2 | CYR61_1 | CTGF_1 | SBA2_1 |
| LMYC_2 | 0.3381 | 0.3259 | 0.3133 |
| LOXL2_1 | CTHRC1_1 | ADAMTS12_1 | INHBA_1 |
| LOXL2_1 | 0.67 | 0.6679 | 0.6613 |
| LOX_1 | UPA_3 | THY1_1 | GJB2_1 |
| LOX_1 | 0.5865 | 0.5672 | 0.5664 |
| MAD2L1_1 | CCNB1_2 | RRM2_1 | NEK2_1 |
| MAD2L1_1 | 0.5725 | 0.558 | 0.5481 |
| MADH7_1 | PDGFC_3 | TAGLN_3 | NRP2_2 |
| MADH7_1 | 0.4952 | 0.4899 | 0.4682 |
| MASPIN_2 | LAMC2_2 | HSD17B2_1 | CDX2_3 |
| MASPIN_2 | 0.433 | 0.4283 | -0.4216 |
| MCM3_3 | RAD54L_1 | RRM2_1 | KI_67_2 |
| MCM3_3 | 0.44 | 0.4396 | 0.4331 |
| MCP1_1 | THBS1_1 | VIM_3 | UPA_3 |
| MCP1_1 | 0.5884 | 0.5833 | 0.5797 |
| MMP1_1 | MCP1_1 | SNAI2_1 | CTSB_1 |
| MMP1_1 | 0.4011 | 0.3891 | 0.3737 |
| MMP2_2 | PDGFRA_2 | VIM_3 | CALD1_2 |
| MMP2_2 | 0.6662 | 0.6556 | 0.6356 |
| MSH2_3 | C_MYB_MYB_OFFICIAL_1 | TOP2A_4 | CSEL1_1 |
| MSH2_3 | 0.3632 | 0.3305 | 0.326 |
| MSH3_2 | HCRA_A_2 | HNRPAB_3 | CD44E_1 |
| MSH3_2 | 0.2878 | 0.2862 | 0.2804 |
| NR4A1_1 | RHOB_1 | C8ORF4_1 | KLF6_1 |
| NR4A1_1 | 0.4623 | 0.422 | 0.3734 |
| NRP1_1 | COL1A2_1 | THBS1_1 | ITGA5_1 |
| NRP1_1 | 0.5871 | 0.5846 | 0.5836 |
| PDGFA_3 | DLC1_1 | HSPG2_1 | CALD1_2 |
| PDGFA_3 | 0.3453 | 0.3422 | 0.3419 |
| PDGFC_3 | COL1A2_1 | TAGLN_3 | IGFBP7_1 |

TABLE C-continued

| | | | |
|---|---|---|---|
| PDGFC_3 | 0.6684 | 0.654 | 0.6538 |
| PDGFD_2 | TAGLN_3 | COL1A2_1 | CALD1_2 |
| PDGFD_2 | 0.3986 | 0.3978 | 0.3865 |
| PDGFRA_2 | CALD1_2 | COL1A2_1 | THBS1_1 |
| PDGFRA_2 | 0.5564 | 0.5392 | 0.5358 |
| PFN2_1 | GIT1_1 | FOXO3A_1 | CTGF_1 |
| PFN2_1 | 0.2905 | 0.2848 | 0.2787 |
| PKR2_1 | MASPIN_2 | KLK10_3 | CTSB_1 |
| PKR2_1 | 0.4999 | 0.4679 | 0.4635 |
| PRDX2_1 | SNRPF_2 | EI24_1 | CCNB1_2 |
| PRDX2_1 | 0.3366 | 0.3296 | 0.3262 |
| RAB32_1 | MMP2_2 | HSPE1_1 | BAD_1 |
| RAB32_1 | 0.3455 | 0.3437 | 0.3392 |
| RAD54L_1 | LMNB1_1 | MCM3_3 | MCM2_2 |
| RAD54L_1 | 0.4483 | 0.44 | 0.4353 |
| RANBP2_3 | RALBP1_1 | HIF1A_3 | TP53BP1_2 |
| RANBP2_3 | 0.3688 | 0.3626 | 0.3596 |
| RCC1_1 | MAD2L1_1 | CDC20_1 | KI_67_2 |
| RCC1_1 | 0.434 | 0.4334 | 0.431 |
| RHOB_1 | AKAP12_2 | CYR61_1 | DLC1_1 |
| RHOB_1 | 0.3951 | 0.3939 | 0.3926 |
| ROCK2_1 | NKD_1_1 | TMEPAI_1 | PKR2_1 |
| ROCK2_1 | 0.3943 | 0.3702 | −0.3628 |
| RUNX1_2 | FZD1_1 | SPARC_1 | IGFBP7_1 |
| RUNX1_2 | 0.5114 | 0.5078 | 0.501 |
| S100P_1 | MUC1_2 | HSD17B2_1 | ANXA2_2 |
| S100P_1 | 0.3285 | 0.3061 | 0.2873 |
| SAT_1 | ANXA2_2 | GBP2_2 | EGLN3_1 |
| SAT_1 | 0.2982 | 0.2852 | 0.2834 |
| SEMA4B_1 | HSD17B2_1 | AXIN_2_3 | C20ORF126_1 |
| SEMA4B_1 | 0.4334 | −0.4193 | −0.4054 |
| SIAT4A_2 | THY1_1 | INHBA_1 | FAP_1 |
| SIAT4A_2 | 0.4375 | 0.427 | 0.4246 |
| SKP2_1 | CDC20_1 | DHFR_2 | PLK_3 |
| SKP2_1 | 0.3739 | 0.358 | 0.3571 |
| SOD1_1 | MUC1_2 | H2AFZ_2 | ANXA2_2 |
| SOD1_1 | 0.267 | 0.2649 | 0.2633 |
| SOS1_1 | FPGS_1 | CREBBP_1 | ITGB1_1 |
| SOS1_1 | 0.2922 | 0.2877 | 0.272 |
| SPARC_1 | IGFBP7_1 | TAGLN_3 | LOXL2_1 |
| SPARC_1 | 0.7715 | 0.7667 | 0.7606 |
| SPRY1_1 | CDH11_1 | TLN1_1 | PAI1_3 |
| SPRY1_1 | 0.4541 | 0.4483 | 0.4369 |
| SPRY2_2 | SBA2_1 | CYP3A4_2 | CAD17_1 |
| SPRY2_2 | 0.3463 | 0.3451 | 0.3445 |
| STK15_2 | BUB1_1 | MCM2_2 | ANTXR1_1 |
| STK15_2 | 0.4311 | 0.4171 | −0.414 |
| TCF_1_1 | GIT1_1 | NEDD8_2 | CDCA7_V2_1 |
| TCF_1_1 | 0.3812 | −0.3754 | 0.3706 |
| THBS1_1 | VIM_3 | INHBA_1 | NRP2_2 |
| THBS1_1 | 0.6723 | 0.6685 | 0.6638 |
| TIMP1_3 | IGFBP5_1 | ITGA5_1 | NRP2_2 |
| TIMP1_3 | 0.6403 | 0.6374 | 0.6172 |
| TOP2A_4 | MYBL2_1 | BUB1_1 | AURKB_1 |
| TOP2A_4 | 0.4194 | 0.4151 | 0.3996 |
| TP53BP1_2 | MMP2_2 | NOTCH1_1 | LRP6_1 |
| TP53BP1_2 | 0.3255 | 0.3247 | 0.3232 |
| UBE2C_1 | CDC2_1 | EREG_1 | C20ORF126_1 |
| UBE2C_1 | 0.4031 | 0.3927 | 0.3874 |
| UPP1_1 | ITGA5_1 | RHOC_1 | BAD_1 |
| UPP1_1 | 0.3457 | 0.339 | 0.3349 |
| VCP_1 | TUFM_1 | KI_67_2 | IGFBP7_1 |
| VCP_1 | 0.437 | 0.4343 | 0.4286 |
| VDAC2_1 | CHK1_2 | CKS2_2 | CDC2_1 |
| VDAC2_1 | 0.364 | 0.3575 | 0.353 |

| Variable | out10 | out11 | out12 |
|---|---|---|---|
| AMFR_1 | PTCH_1 | NOTCH1_1 | IGFBP5_1 |
| AMFR_1 | 0.2777 | 0.2713 | 0.2701 |
| ANXA1_2 | ITGB1_1 | TIMP3_3 | KLK10_3 |
| ANXA1_2 | 0.488 | 0.477 | 0.4727 |
| APC_4 | CDC42BPA_1 | RANBP2_3 | CTGF_1 |
| APC_4 | 0.3341 | 0.3282 | 0.3199 |
| AURKB_1 | CHK1_2 | RRM1_1 | CDC6_1 |
| AURKB_1 | 0.4285 | 0.4231 | 0.4086 |
| AXIN_2_3 | PKR2_1 | REG4_1 | SEMA4B_1 |
| AXIN_2_3 | −0.4449 | −0.4321 | −0.4193 |
| BGN_1 | CTHRC1_1 | LOXL2_1 | COL1A2_1 |
| BGN_1 | 0.7668 | 0.7415 | 0.7368 |

TABLE C-continued

| | | | |
|---|---|---|---|
| BIK_1 | VEGFB_1 | UBE2C_1 | TMEPAI_1 |
| BIK_1 | −0.2501 | −0.2383 | −0.2382 |
| BRAF_5 | CAD17_1 | C_MYB_MYB_OFFICIAL_1 | ABCC5_1 |
| BRAF_5 | 0.3433 | 0.3407 | 0.3365 |
| BRAF_SNP1_6 | MASPIN_2 | AREG_2 | SEMA4B_1 |
| BRAF_SNP1_6 | 0.3695 | −0.3614 | 0.3559 |
| BRCA2_2 | CENPF_1 | C20ORF126_1 | RAF1_3 |
| BRCA2_2 | 0.2149 | 0.2132 | 0.2047 |
| BUB1_1 | TK1_2 | PLK_3 | PCNA_2 |
| BUB1_1 | 0.4803 | 0.4716 | 0.4617 |
| B_CATENIN_3 | TMEPAI_1 | AXIN_2_3 | SPRY2_2 |
| B_CATENIN_3 | 0.3481 | 0.3475 | 0.3467 |
| C20ORF126_1 | E2F1_3 | SEMA4B_1 | ANXA1_2 |
| C20ORF126_1 | 0.4259 | −0.4054 | −0.3947 |
| C20_ORF1_1 | TOP2A_4 | CDCA7_V2_1 | CDH1_INTRON_2_2 |
| C20_ORF1_1 | 0.3958 | 0.3928 | 0.3902 |
| CALD1_2 | SPARC_1 | NRP2_2 | BGN_1 |
| CALD1_2 | 0.649 | 0.6417 | 0.6378 |
| CASP9_1 | GSK3B_2 | EPAS1_1 | PI3K_2 |
| CASP9_1 | 0.2006 | 0.1962 | 0.196 |
| CCNE2_2 | IGFBP7_1 | SPARC_1 | GPX1_2 |
| CCNE2_2 | −0.2985 | −0.2975 | −0.2968 |
| CCNE2_VARIANT_1_1 | SURV_2 | MCM3_3 | CD44E_1 |
| CCNE2_VARIANT_1_1 | 0.3156 | 0.3125 | 0.3014 |
| CD44E_1 | CCNB1_2 | SLC25A3_2 | ODC1_3 |
| CD44E_1 | 0.3814 | 0.376 | 0.3734 |
| CD44S_1 | COL1A2_1 | TIMP1_3 | MMP2_2 |
| CD44S_1 | 0.5643 | 0.5624 | 0.5612 |
| CD44V6_1 | HDAC1_1 | VEGF_ALTSPLICE2_1 | PS2_2 |
| CD44V6_1 | 0.335 | 0.3329 | 0.3326 |
| CD68_2 | MMP2_2 | PAI1_3 | VIM_3 |
| CD68_2 | 0.4758 | 0.4713 | 0.4683 |
| CDC2_1 | RAD54L_1 | TK1_2 | NEK2_1 |
| CDC2_1 | 0.4949 | 0.4933 | 0.4928 |
| CDC4_1 | BRAF_5 | HIF1A_3 | CSF1_1 |
| CDC4_1 | 0.2667 | 0.2656 | 0.2588 |
| CDH11_1 | PDGFC_3 | INHBA_1 | SFRP4_1 |
| CDH11_1 | 0.6845 | 0.6744 | 0.6734 |
| CDX2_3 | CDCA7_V2_1 | FUT6_2 | BRAF_SNP1_6 |
| CDX2_3 | 0.4609 | 0.4566 | −0.4561 |
| CENPA_1 | KIF22_1 | KIFC1_1 | STK15_2 |
| CENPA_1 | 0.3575 | 0.3561 | 0.3541 |
| CENPF_1 | CHK1_2 | CCNA2_1 | SKP2_1 |
| CENPF_1 | 0.4173 | 0.4134 | 0.4123 |
| CHFR_1 | ANTXR1_1 | IGFBP7_1 | IGFBP3_3 |
| CHFR_1 | 0.3559 | 0.3541 | 0.3522 |
| CHK1_2 | CENPF_1 | HNRPAB_3 | IGFBP7_1 |
| CHK1_2 | 0.4173 | 0.3988 | −0.3928 |
| CLDN1_1 | RUNX1_2 | IGFBP3_3 | STMY3_3 |
| CLDN1_1 | 0.2403 | 0.2388 | 0.2313 |
| CLIC1_1 | C_SRC_1 | KIFC1_1 | LRP5_1 |
| CLIC1_1 | 0.318 | 0.3173 | 0.3166 |
| CLTC_1 | PRKCA_1 | HSPA1B_1 | THY1_1 |
| CLTC_1 | 0.2651 | −0.262 | 0.26 |
| CMYC_3 | SNRPF_2 | E2F1_3 | ATP5E_1 |
| CMYC_3 | 0.4402 | 0.4391 | 0.439 |
| COL1A1_1 | WISP1_1 | SFRP2_1 | THY1_1 |
| COL1A1_1 | 0.7442 | 0.7263 | 0.7241 |
| COL1A2_1 | INHBA_1 | VIM_3 | CTGF_1 |
| COL1A2_1 | 0.7005 | 0.6897 | 0.6893 |
| CREBBP_1 | TGFBR2_3 | AKT3_2 | TP53BP2_2 |
| CREBBP_1 | 0.3168 | 0.3151 | 0.3054 |
| CTSB_1 | TP_3 | CD18_2 | CYP1B1_3 |
| CTSB_1 | 0.5461 | 0.5281 | 0.5213 |
| CTSL_2 | CD68_2 | VIM_3 | CD18_2 |
| CTSL_2 | 0.6148 | 0.6109 | 0.6096 |
| CXCL12_1 | MCP1_1 | CYP1B1_3 | WISP1_1 |
| CXCL12_1 | 0.6022 | 0.5972 | 0.5945 |
| CYR61_1 | GADD45B_1 | FOS_1 | SFRP2_1 |
| CYR61_1 | 0.573 | 0.5673 | 0.567 |
| DLC1_1 | TLN1_1 | PDGFC_3 | CTGF_1 |
| DLC1_1 | 0.5982 | 0.5964 | 0.5926 |
| DUSP1_1 | EGR3_1 | INHBA_1 | ITGA5_1 |
| DUSP1_1 | 0.5184 | 0.5115 | 0.5081 |
| E2F1_3 | ANXA1_2 | SURV_2 | TERC_1 |
| E2F1_3 | −0.411 | 0.3813 | 0.3697 |
| EFNB2_1 | IGFBP7_1 | MRP3_1 | CLIC1_1 |
| EFNB2_1 | 0.3235 | 0.3163 | 0.3132 |
| EGR3_1 | GADD45B_1 | CTGF_1 | INHBA_1 |
| EGR3_1 | 0.3462 | 0.3455 | 0.3448 |

TABLE C-continued

| | | | |
|---|---|---|---|
| EI24_1 | KRT8_3 | TUFM_1 | KIF22_1 |
| EI24_1 | 0.3037 | 0.2928 | 0.2927 |
| ENO1_1 | UBE2M_2 | ANXA2_2 | SNRPF_2 |
| ENO1_1 | 0.4328 | 0.4262 | 0.4214 |
| EPAS1_1 | SPARC_1 | CXCL12_1 | DUSP1_1 |
| EPAS1_1 | 0.477 | 0.4748 | 0.4739 |
| ESPL1_3 | NEK2_1 | RAD54L_1 | KIFC1_1 |
| ESPL1_3 | 0.4239 | 0.4104 | 0.3996 |
| FBXO5_1 | ODC1_3 | CHK1_2 | MAD2L1_1 |
| FBXO5_1 | 0.352 | 0.3498 | 0.3388 |
| FGF18_2 | PDGFC_3 | ANTXR1_1 | CREBBP_1 |
| FGF18_2 | 0.2749 | 0.2734 | 0.2628 |
| FGF2_2 | IGFBP5_1 | TIMP2_1 | OSMR_1 |
| FGF2_2 | 0.3174 | 0.3146 | 0.3139 |
| FOS_1 | GADD45B_1 | PLK3_1 | KLF6_1 |
| FOS_1 | 0.4488 | 0.4469 | 0.4468 |
| FOXO3A_1 | TLN1_1 | IGFBP7_1 | KLF5_1 |
| FOXO3A_1 | 0.3998 | 0.3996 | 0.3981 |
| FPGS_1 | HDAC1_1 | HSPG2_1 | SHC1_1 |
| FPGS_1 | 0.2702 | 0.2608 | 0.2593 |
| FST_1 | CYP1B1_3 | TIMP3_3 | ANTXR1_1 |
| FST_1 | 0.3935 | 0.3895 | 0.3837 |
| FZD1_1 | MYLK_1 | TAGLN_3 | BGN_1 |
| FZD1_1 | 0.5546 | 0.5533 | 0.5476 |
| GJB2_1 | SFRP2_1 | THY1_1 | UPA_3 |
| GJB2_1 | 0.4813 | 0.4812 | 0.4766 |
| GPX1_2 | TIMP2_1 | VEGFB_1 | LOX_1 |
| GPX1_2 | 0.3807 | 0.3796 | 0.378 |
| GRB10_1 | EGR3_1 | EMP1_1 | FAP_1 |
| GRB10_1 | 0.218 | 0.2168 | 0.2152 |
| GSK3B_2 | SBA2_1 | FOXO3A_1 | PTCH_1 |
| GSK3B_2 | 0.4038 | 0.4026 | 0.3963 |
| HES6_1 | B_CATENIN_3 | TFF3_3 | CLTC_1 |
| HES6_1 | 0.3065 | 0.3017 | 0.01848 |
| HIF1A_3 | THBS1_1 | ITGAV_1 | CYR61_1 |
| HIF1A_3 | 0.5049 | 0.5024 | 0.4931 |
| HLA_G_2 | LAT_1 | KLF6_1 | RHOC_1 |
| HLA_G_2 | 0.098 | 0.0958 | 0.0951 |
| HNRPAB_3 | ODC1_3 | RANBP2_3 | MSH2_3 |
| HNRPAB_3 | 0.4196 | 0.4152 | 0.4123 |
| HNRPD_1 | CDC6_1 | LMNB1_1 | CLTC_1 |
| HNRPD_1 | 0.3646 | 0.3601 | 0.3483 |
| HOXA5_1 | ITGB1_1 | RCC1_1 | EFNB2_1 |
| HOXA5_1 | 0.2705 | −0.2694 | 0.2621 |
| HOXB13_1 | HOXA5_1 | SLC31A1_1 | MRP3_1 |
| HOXB13_1 | −0.1536 | 0.1532 | 0.1515 |
| HSD17B2_1 | CYP2C8_2 | F3_1 | SI_1 |
| HSD17B2_1 | 0.3566 | 0.3445 | 0.3314 |
| HSPA1A_1 | CTSB_1 | SPARC_1 | TIMP3_3 |
| HSPA1A_1 | 0.359 | 0.355 | 0.3529 |
| HSPA1B_1 | TLN1_1 | DLC1_1 | CLAUDIN_4_2 |
| HSPA1B_1 | −0.2033 | −0.1995 | 0.1939 |
| HSPE1_1 | MSH2_3 | AREG_2 | HSPA8_1 |
| HSPE1_1 | 0.4117 | 0.4078 | 0.4061 |
| IGFBP3_3 | IGFBP5_1 | LEF_1 | CALD1_2 |
| IGFBP3_3 | 0.4784 | 0.4674 | 0.4665 |
| IGFBP5_1 | BGN_1 | VIM_3 | HSPG2_1 |
| IGFBP5_1 | 0.6374 | 0.6343 | 0.6259 |
| IGFBP7_1 | PDGFC_3 | CALD1_2 | BGN_1 |
| IGFBP7_1 | 0.6538 | 0.6494 | 0.6467 |
| IL6ST_3 | CALD1_2 | OSMR_1 | RUNX1_2 |
| IL6ST_3 | 0.4588 | 0.4498 | 0.4482 |
| KI_67_2 | RRM2_1 | SNRPF_2 | CCNB1_2 |
| KI_67_2 | 0.482 | 0.4678 | 0.4672 |
| KIF22_1 | BUB1_1 | LMNB1_1 | CDC20_1 |
| KIF22_1 | 0.4089 | 0.4069 | 0.4048 |
| KIFC1_1 | BUB1_1 | RAD54L_1 | MCM2_2 |
| KIFC1_1 | 0.4599 | 0.4585 | 0.4427 |
| KLF5_1 | G_CATENIN_1 | FOXO3A_1 | MRP3_1 |
| KLF5_1 | 0.4017 | 0.3981 | 0.3948 |
| KLK10_3 | ATP5E_1 | PLK3_1 | HES6_1 |
| KLK10_3 | −0.337 | 0.3297 | −0.3229 |
| KLK6_1 | MASPIN_2 | CGB_1 | UPA_3 |
| KLK6_1 | 0.2493 | 0.2471 | 0.2369 |
| KLRK1_2 | TRAIL_1 | CRIPTO_TDGF1_OFFICIAL_1 | ANXA2_2 |
| KLRK1_2 | 0.4058 | −0.3563 | 0.3354 |
| KRT8_3 | LAMA3_1 | VCP_1 | IRS1_3 |
| KRT8_3 | 0.4151 | 0.4132 | 0.3883 |
| LAT_1 | GBP2_2 | TAGLN_3 | CTSL_2 |
| LAT_1 | 0.3876 | 0.3769 | 0.3759 |

TABLE C-continued

| | | | |
|---|---|---|---|
| LEF_1 | CALD1_2 | MYLK_1 | RUNX1_2 |
| LEF_1 | 0.4488 | 0.447 | 0.4456 |
| LMYC_2 | DPYD_2 | CALD1_2 | ITGB1_1 |
| LMYC_2 | 0.3114 | 0.3112 | 0.3108 |
| LOXL2_1 | FAP_1 | WISP1_1 | THY1_1 |
| LOXL2_1 | 0.6439 | 0.6237 | 0.6215 |
| LOX_1 | SFRP2_1 | TGFB3_1 | THBS1_1 |
| LOX_1 | 0.5599 | 0.5536 | 0.5533 |
| MAD2L1_1 | BUB1_1 | NME1_3 | MCM3_3 |
| MAD2L1_1 | 0.5271 | 0.5143 | 0.491 |
| MADH7_1 | IGFBP5_1 | TIMP2_1 | VIM_3 |
| MADH7_1 | 0.4592 | 0.4532 | 0.452 |
| MASPIN_2 | ANXA1_2 | PS2_2 | DAPK1_3 |
| MASPIN_2 | 0.4196 | 0.4193 | 0.4149 |
| MCM3_3 | BUB1_1 | TK1_2 | KIF22_1 |
| MCM3_3 | 0.4321 | 0.4313 | 0.4297 |
| MCP1_1 | CTGF_1 | COL1A2_1 | TIMP2_1 |
| MCP1_1 | 0.5796 | 0.5787 | 0.5718 |
| MMP1_1 | CD44S_1 | COL1A2_1 | PAI1_3 |
| MMP1_1 | 0.36 | 0.3467 | 0.3371 |
| MMP2_2 | NRP2_2 | SNAI2_1 | NRP1_1 |
| MMP2_2 | 0.6188 | 0.6175 | 0.6168 |
| MSH2_3 | MCM6_3 | RBX1_1 | HDAC1_1 |
| MSH2_3 | 0.3227 | 0.3158 | 0.3106 |
| MSH3_2 | ITGAV_1 | ROCK1_1 | RBX1_1 |
| MSH3_2 | 0.2771 | 0.277 | 0.2762 |
| NR4A1_1 | CTGF_1 | GADD45B_1 | PLK3_1 |
| NR4A1_1 | 0.3655 | 0.3547 | 0.3514 |
| NRP1_1 | TAGLN_3 | NRP2_2 | CTGF_1 |
| NRP1_1 | 0.5771 | 0.5755 | 0.5582 |
| PDGFA_3 | CCNB1_2 | SFRP4_1 | TGFBR2_3 |
| PDGFA_3 | −0.3389 | 0.3308 | 0.3286 |
| PDGFC_3 | SFRP4_1 | NRP2_2 | COL1A1_1 |
| PDGFC_3 | 0.6487 | 0.6436 | 0.6281 |
| PDGFD_2 | SFRP4_1 | TIMP2_1 | CTGF_1 |
| PDGFD_2 | 0.3805 | 0.3799 | 0.3781 |
| PDGFRA_2 | SPARC_1 | FZD1_1 | PDGFC_3 |
| PDGFRA_2 | 0.5058 | 0.4929 | 0.4858 |
| PFN2_1 | PRDX4_1 | RBX1_1 | BLMH_1 |
| PFN2_1 | 0.2783 | 0.2775 | 0.277 |
| PKR2_1 | TS_1 | C20ORF126_1 | CRIPTO_TDGF1_OFFICIAL_1 |
| PKR2_1 | 0.4591 | −0.4551 | −0.4512 |
| PRDX2_1 | LMNB1_1 | PCNA_2 | FAP_1 |
| PRDX2_1 | 0.3222 | 0.319 | −0.3178 |
| RAB32_1 | CRIPTO_TDGF1_OFFICIAL_1 | PI3K_2 | FOXO3A_1 |
| RAB32_1 | 0.333 | 0.3224 | 0.3219 |
| RAD54L_1 | TS_1 | KIF22_1 | TK1_2 |
| RAD54L_1 | 0.4291 | 0.4178 | 0.4158 |
| RANBP2_3 | LMYC_2 | BRAF_5 | MADH2_1 |
| RANBP2_3 | 0.3586 | 0.3476 | 0.3417 |
| RCC1_1 | BUB1_1 | VCP_1 | TGFBR2_3 |
| RCC1_1 | 0.4281 | 0.4176 | −0.4168 |
| RHOB_1 | ANTXR1_1 | CALD1_2 | EGR3_1 |
| RHOB_1 | 0.3908 | 0.3771 | 0.3764 |
| ROCK2_1 | EPHB2_1 | CAD17_1 | ENO1_1 |
| ROCK2_1 | 0.3613 | 0.3528 | −0.3259 |
| RUNX1_2 | INHBA_1 | NRP2_2 | AKT3_2 |
| RUNX1_2 | 0.4947 | 0.4941 | 0.4925 |
| S100P_1 | SEMA4B_1 | C20ORF126_1 | CD44V6_1 |
| S100P_1 | 0.287 | −0.2817 | 0.2751 |
| SAT_1 | COL1A1_1 | P21_3 | CD44S_1 |
| SAT_1 | 0.2795 | 0.2773 | 0.2771 |
| SEMA4B_1 | TS_1 | CRIPTO_TDGF1_OFFICIAL_1 | KLK10_3 |
| SEMA4B_1 | 0.402 | −0.4007 | 0.3896 |
| SIAT4A_2 | UPA_3 | TIMP1_3 | CTSB_1 |
| SIAT4A_2 | 0.4198 | 0.4161 | 0.415 |
| SKP2_1 | KIFC1_1 | TOP2A_4 | MCM3_3 |
| SKP2_1 | 0.3544 | 0.3486 | 0.3486 |
| SOD1_1 | TMSB10_1 | APG_1_1 | TK1_2 |
| SOD1_1 | 0.2577 | 0.2528 | 0.2498 |
| SOS1_1 | MADH2_1 | HOXAS_1 | TRAIL_1 |
| SOS1_1 | 0.2624 | 0.2574 | 0.2549 |
| SPARC_1 | THY1_1 | LOX_1 | ADAMTS12_1 |
| SPARC_1 | 0.7512 | 0.7433 | 0.7317 |
| SPRY1_1 | PDGFRA_2 | IGFBP5_1 | COL1A2_1 |
| SPRY1_1 | 0.4312 | 0.4282 | 0.4167 |
| SPRY2_2 | MADH7_1 | NKD_1_1 | MGAT5_1 |
| SPRY2_2 | 0.3444 | 0.3385 | 0.3314 |
| STK15_2 | BGN_1 | TGFB3_1 | P21_3 |
| STK15_2 | −0.3956 | −0.3951 | −0.3948 |

TABLE C-continued

| | | | |
|---|---|---|---|
| TCF__1__1 | IRS1__3 | ABCC6__1 | ATP5E__1 |
| TCF__1__1 | 0.361 | 0.3586 | 0.3529 |
| THBS1__1 | CDH11__1 | CYR61__1 | TAGLN__3 |
| THBS1__1 | 0.6635 | 0.6623 | 0.6601 |
| TIMP1__3 | NRP1__1 | IGFBP7__1 | TAGLN__3 |
| TIMP1__3 | 0.6172 | 0.6157 | 0.6115 |
| TOP2A__4 | C20__ORF1__1 | CCNA2__1 | RAD54L__1 |
| TOP2A__4 | 0.3958 | 0.3937 | 0.3925 |
| TP53BP1__2 | ROCK1__1 | MYLK__1 | B__CATENIN__3 |
| TP53BP1__2 | 0.3212 | 0.3183 | 0.3149 |
| UBE2C__1 | ATP5E__1 | CMYC__3 | CCNB1__2 |
| UBE2C__1 | 0.378 | 0.3636 | 0.3603 |
| UPP1__1 | TIMP1__3 | GBP2__2 | CIAP2__2 |
| UPP1__1 | 0.3331 | 0.3308 | 0.3292 |
| VCP__1 | RCC1__1 | VEGFB__1 | UMPS__2 |
| VCP__1 | 0.4176 | 0.4171 | 0.4166 |
| VDAC2__1 | CCNB1__2 | ATP5A1__1 | CDC20__1 |
| VDAC2__1 | 0.3506 | 0.3464 | 0.3448 |

| Variable | out13 | out14 | out15 |
|---|---|---|---|
| AMFR__1 | TCF__1__1 | PGK1__1 | KCNH2__ISO__A__C__1 |
| AMFR__1 | 0.2674 | −0.2633 | 0.2554 |
| ANXA1__2 | COL1A1__1 | CTSL__2 | P21__3 |
| ANXA1__2 | 0.469 | 0.4678 | 0.4669 |
| APC__4 | LMYC__2 | FZD1__1 | AKT3__2 |
| APC__4 | 0.3067 | 0.3065 | 0.3028 |
| AURKB__1 | RAD54L__1 | TOP2A__4 | SKP2__1 |
| AURKB__1 | 0.4048 | 0.3996 | 0.3991 |
| AXIN__2__3 | CDCA7__V2__1 | MGAT5__1 | PTP4A3__V2__1 |
| AXIN__2__3 | 0.4132 | 0.4076 | 0.403 |
| BGN__1 | THY1__1 | CDH11__1 | TIMP3__3 |
| BGN__1 | 0.7265 | 0.7265 | 0.7053 |
| BIK__1 | SEMA4B__1 | C20ORF126__1 | PKR2__1 |
| BIK__1 | 0.2378 | −0.236 | 0.2296 |
| BRAF__5 | TP53BP1__2 | MYH11__1 | MSH3__2 |
| BRAF__5 | 0.336 | 0.3336 | 0.3316 |
| BRAF__SNP1__6 | PTP4A3__V2__1 | DAPK1__3 | EPHB2__1 |
| BRAF__SNP1__6 | −0.3209 | 0.3181 | −0.3165 |
| BRCA2__2 | CDX2__3 | CUL4A__1 | CDH1__INTRON__2__2 |
| BRCA2__2 | 0.2041 | 0.203 | 0.1978 |
| BUB1__1 | KIFC1__1 | RAD54L__1 | CENPF__1 |
| BUB1__1 | 0.4599 | 0.459 | 0.4578 |
| B__CATENIN__3 | FOXO3A__1 | CD24__1 | EPHB2__1 |
| B__CATENIN__3 | 0.3442 | 0.3437 | 0.329 |
| C20ORF126__1 | CDH1__INTRON__2__2 | UBE2C__1 | ENO1__1 |
| C20ORF126__1 | 0.3885 | 0.3874 | −0.382 |
| C20__ORF1__1 | SGCB__1 | MUC1__2 | KIFC1__1 |
| C20__ORF1__1 | −0.3853 | −0.3851 | 0.3841 |
| CALD1__2 | COL1A2__1 | VIM__3 | MMP2__2 |
| CALD1__2 | 0.6362 | 0.6359 | 0.6356 |
| CASP9__1 | PGK1__1 | LMYC__2 | PRKCA__1 |
| CASP9__1 | −0.1923 | 0.1879 | 0.1878 |
| CCNE2__2 | PDGFC__3 | EMP1__1 | COL1A1__1 |
| CCNE2__2 | −0.2946 | −0.2934 | −0.2931 |
| CCNE2__VARIANT__1__1 | RRM1__2 | E2F1__3 | MCM2__2 |
| CCNE2__VARIANT__1__1 | 0.2946 | 0.2934 | 0.2929 |
| CD44E__1 | C__MYB__MYB__OFFICIAL__1 | GCNT1__1 | MRP3__1 |
| CD44E__1 | 0.3716 | 0.3712 | 0.3625 |
| CD44S__1 | CXCL12__1 | TIMP2__1 | CSF1__1 |
| CD44S__1 | 0.5556 | 0.551 | 0.5501 |
| CD44V6__1 | CCNB1__2 | TLN1__1 | EFP__3 |
| CD44V6__1 | 0.3317 | 0.3281 | 0.3249 |
| CD68__2 | COL1A2__1 | NRP2__2 | CTGF__1 |
| CD68__2 | 0.4681 | 0.4629 | 0.4613 |
| CDC2__1 | MCM2__2 | ESPL1__3 | KIFC1__1 |
| CDC2__1 | 0.4778 | 0.4762 | 0.4715 |
| CDC4__1 | ROCK1__1 | NFKBP50__3 | CREBBP__1 |
| CDC4__1 | 0.2563 | 0.2504 | 0.2461 |
| CDH11__1 | ANTXR1__1 | THBS1__1 | NRP2__2 |
| CDH11__1 | 0.6665 | 0.6635 | 0.6615 |
| CDX2__3 | ROCK2__1 | NKD__1__1 | TP__3 |
| CDX2__3 | 0.4547 | 0.4493 | −0.436 |
| CENPA__1 | RAD54L__1 | MCM2__2 | TS__1 |
| CENPA__1 | 0.3493 | 0.3273 | 0.3254 |
| CENPF__1 | CCNB1__2 | LMNB1__1 | MCM3__3 |
| CENPF__1 | 0.4015 | 0.4011 | 0.3979 |
| CHFR__1 | CDH11__1 | FOXO3A__1 | NRP2__2 |
| CHFR__1 | 0.3498 | 0.3489 | 0.3483 |
| CHK1__2 | TOP2A__4 | MSH2__3 | SKP2__1 |

TABLE C-continued

| | | | |
|---|---|---|---|
| CHK1_2 | 0.3791 | 0.3787 | 0.3782 |
| CLDN1_1 | BRCA2_2 | NKD_1_1 | CREBBP_1 |
| CLDN1_1 | 0.2196 | 0.2189 | 0.2182 |
| CLIC1_1 | CMYC_3 | EFNB2_1 | TLN1_1 |
| CLIC1_1 | 0.3137 | 0.3132 | 0.3117 |
| CLTC_1 | EFP_3 | PGK1_1 | ITGB4_2 |
| CLTC_1 | 0.2597 | −0.2573 | 0.2559 |
| CMYC_3 | UMPS_2 | PRDX4_1 | CDX2_3 |
| CMYC_3 | 0.4255 | 0.4014 | 0.3997 |
| COL1A1_1 | INHBA_1 | ADAMTS12_1 | LOX_1 |
| COL1A1_1 | 0.7202 | 0.7077 | 0.7065 |
| COL1A2_1 | TIMP2_1 | SNAI2_1 | PDGFC_3 |
| COL1A2_1 | 0.6874 | 0.6764 | 0.6684 |
| CREBBP_1 | LEF_1 | IL6ST_3 | ABCC5_1 |
| CREBBP_1 | 0.3042 | 0.2994 | 0.2983 |
| CTSB_1 | WISP1_1 | OPN_OSTEOPONTIN_3 | CSF1_1 |
| CTSB_1 | 0.519 | 0.5168 | 0.5143 |
| CTSL_2 | NRP1_1 | CD44S_1 | MMP2_2 |
| CTSL_2 | 0.6068 | 0.6046 | 0.5971 |
| CXCL12_1 | CTHRC1_1 | FAP_1 | COL1A2_1 |
| CXCL12_1 | 0.5935 | 0.5903 | 0.5786 |
| CYR61_1 | SPARC_1 | MMP2_2 | ITGA5_1 |
| CYR61_1 | 0.5655 | 0.563 | 0.5564 |
| DLC1_1 | VIM_3 | SPARC_1 | CDH11_1 |
| DLC1_1 | 0.5913 | 0.5903 | 0.5872 |
| DUSP1_1 | DLC1_1 | HB_EGF_1 | VIM_3 |
| DUSP1_1 | 0.507 | 0.5018 | 0.4985 |
| E2F1_3 | NME1_3 | MAD2L1_1 | CDC2_1 |
| E2F1_3 | 0.3583 | 0.3517 | 0.3502 |
| EFNB2_1 | TP53BP2_2 | MADH7_1 | LEF_1 |
| EFNB2_1 | 0.313 | 0.3057 | 0.305 |
| EGR3_1 | WISP1_1 | DLC1_1 | FAP_1 |
| EGR3_1 | 0.3263 | 0.3193 | 0.3083 |
| EI24_1 | K_RAS_SNP1_8 | SURV_2 | PCNA_2 |
| EI24_1 | −0.2915 | 0.2886 | 0.2837 |
| ENO1_1 | NME1_3 | MAD2L1_1 | EGLN3_1 |
| ENO1_1 | 0.4166 | 0.4147 | 0.4046 |
| EPAS1_1 | MMP2_2 | IL6ST_3 | FZD1_1 |
| EPAS1_1 | 0.4673 | 0.4652 | 0.4637 |
| ESPL1_3 | H2AFZ_2 | KIF22_1 | CENPA_1 |
| ESPL1_3 | 0.3994 | 0.3918 | 0.3671 |
| FBXO5_1 | TOP2A_4 | CCNA2_1 | RRM1_2 |
| FBXO5_1 | 0.3378 | 0.3364 | 0.3342 |
| FGF18_2 | AXIN_2_3 | AKT3_2 | CALD1_2 |
| FGF18_2 | 0.2601 | 0.2565 | 0.2564 |
| FGF2_2 | MCP1_1 | CALD1_2 | PTGER3_1 |
| FGF2_2 | 0.3051 | 0.2937 | 0.2934 |
| FOS_1 | RHOB_1 | THBS1_1 | INHBA_1 |
| FOS_1 | 0.4315 | 0.3766 | 0.3762 |
| FOXO3A_1 | HER2_3 | TP53BP2_2 | MYH11_1 |
| FOXO3A_1 | 0.3952 | 0.3893 | 0.3886 |
| FPGS_1 | IGFBP3_3 | FUT6_2 | TGFBR1_1 |
| FPGS_1 | 0.2592 | 0.2561 | 0.2549 |
| FST_1 | CTHRC1_1 | CTGF_1 | CALD1_2 |
| FST_1 | 0.3805 | 0.3685 | 0.3627 |
| FZD1_1 | CTHRC1_1 | SFRP4_1 | CALD1_2 |
| FZD1_1 | 0.5458 | 0.5429 | 0.5383 |
| GJB2_1 | CYP1B1_3 | COL1A2_1 | ADAMTS12_1 |
| GJB2_1 | 0.4759 | 0.4748 | 0.4719 |
| GPX1_2 | CCNA2_1 | CD18_2 | NEDD8_2 |
| GPX1_2 | −0.3771 | 0.3763 | −0.3654 |
| GRB10_1 | ANTXR1_1 | GADD45B_1 | PLK3_1 |
| GRB10_1 | 0.2147 | 0.21 | 0.2094 |
| GSK3B_2 | AXIN1_1 | TUFM_1 | CMYC_3 |
| GSK3B_2 | 0.3841 | 0.3797 | 0.3772 |
| HES6_1 | ODC1_3 | CXCR4_3 | PTCH_1 |
| HES6_1 | 0.2925 | −0.2925 | 0.29 |
| HIF1A_3 | PAI1_3 | UPA_3 | FYN_3 |
| HIF1A_3 | 0.4902 | 0.4892 | 0.4783 |
| HLA_G_2 | SMARCA3_1 | HSPA1A_1 | UPA_3 |
| HLA_G_2 | 0.0948 | 0.0946 | 0.0933 |
| HNRPAB_3 | RALBP1_1 | HDAC1_1 | CHK1_2 |
| HNRPAB_3 | 0.4123 | 0.3994 | 0.3988 |
| HNRPD_1 | NME1_3 | DHFR_2 | EFP_3 |
| HNRPD_1 | 0.3459 | 0.3451 | 0.3367 |
| HOXA5_1 | H2AFZ_2 | MGAT5_1 | SOS1_1 |
| HOXA5_1 | −0.2577 | 0.2576 | 0.2574 |
| HOXB13_1 | IRS1_3 | F3_1 | WISP1_1 |
| HOXB13_1 | 0.1512 | 0.1509 | −0.1501 |
| HSD17B2_1 | SLPI_1 | MUC2_1 | AXIN_2_3 |

TABLE C-continued

| | | | |
|---|---|---|---|
| HSD17B2_1 | 0.3305 | 0.3261 | −0.3248 |
| HSPA1A_1 | TIMP2_1 | HSPA1B_1 | PLK3_1 |
| HSPA1A_1 | 0.3524 | 0.3521 | 0.3446 |
| HSPA1B_1 | STC1_1 | CENPA_1 | SBA2_1 |
| HSPA1B_1 | 0.1927 | 0.1905 | −0.1883 |
| HSPE1_1 | CD44E_1 | THY1_1 | EREG_1 |
| HSPE1_1 | 0.4043 | −0.4037 | 0.3909 |
| IGFBP3_3 | CDH11_1 | RUNX1_2 | TGFB3_1 |
| IGFBP3_3 | 0.4654 | 0.4596 | 0.4561 |
| IGFBP5_1 | TLN1_1 | THY1_1 | ADAMTS12_1 |
| IGFBP5_1 | 0.6221 | 0.622 | 0.6219 |
| IGFBP7_1 | MYLK_1 | ADAMTS12_1 | NRP2_2 |
| IGFBP7_1 | 0.6456 | 0.6433 | 0.6374 |
| IL6ST_3 | CSF1_1 | MYLK_1 | FAP_1 |
| IL6ST_3 | 0.4438 | 0.4413 | 0.4408 |
| KI_67_2 | KIFC1_1 | RAD54L_1 | ESPL1_3 |
| KI_67_2 | 0.4614 | 0.458 | 0.4577 |
| KIF22_1 | PCNA_2 | CDC25C_1 | ESPL1_3 |
| KIF22_1 | 0.3983 | 0.3962 | 0.3918 |
| KIFC1_1 | CHK1_2 | TOP2A_4 | PCNA_2 |
| KIFC1_1 | 0.4332 | 0.429 | 0.4097 |
| KLF5_1 | TUFM_1 | GSTP_3 | HER2_3 |
| KLF5_1 | 0.3891 | 0.3846 | 0.3818 |
| KLK10_3 | P21_3 | C20ORF126_1 | LAMC2_2 |
| KLK10_3 | 0.3213 | −0.3166 | 0.3161 |
| KLK6_1 | P21_3 | AKAP12_2 | LAMC2_2 |
| KLK6_1 | 0.2318 | 0.2316 | 0.2265 |
| KLRK1_2 | LAT_1 | CDX2_3 | IL6ST_3 |
| KLRK1_2 | 0.3333 | −0.3299 | 0.3216 |
| KRT8_3 | RRM2_1 | RHOC_1 | RBX1_1 |
| KRT8_3 | 0.3872 | 0.3866 | 0.3849 |
| LAT_1 | PRKCB1_1 | CAPG_1 | CD68_2 |
| LAT_1 | 0.3735 | 0.3629 | 0.3496 |
| LEF_1 | MADH7_1 | IGFBP5_1 | HSPG2_1 |
| LEF_1 | 0.44 | 0.4348 | 0.4259 |
| LMYC_2 | VEGF_ALTSPLICE1_1 | P53R2_3 | APC_4 |
| LMYC_2 | 0.3104 | 0.3076 | 0.3067 |
| LOXL2_1 | CDH11_1 | ITGA5_1 | TIMP3_3 |
| LOXL2_1 | 0.6205 | 0.6129 | 0.6125 |
| LOX_1 | TIMP1_3 | TIMP2_1 | ADAMTS12_1 |
| LOX_1 | 0.5524 | 0.5512 | 0.5512 |
| MAD2L1_1 | BAD_1 | HSPE1_1 | VCP_1 |
| MAD2L1_1 | 0.4674 | 0.458 | 0.4564 |
| MADH7_1 | BGN_1 | CTGF_1 | LEF_1 |
| MADH7_1 | 0.4422 | 0.4413 | 0.44 |
| MASPIN_2 | F3_1 | CRIPTO_TDGF1_OFFICIAL_1 | BRAF_SNP1_6 |
| MASPIN_2 | 0.3972 | −0.3952 | 0.3695 |
| MCM3_3 | TUFM_1 | FBXO5_1 | CCNB1_2 |
| MCM3_3 | 0.4289 | 0.4144 | 0.4117 |
| MCP1_1 | BGN_1 | CTHRC1_1 | MMP2_2 |
| MCP1_1 | 0.5688 | 0.5633 | 0.5618 |
| MMP1_1 | COL1A1_1 | CTHRC1_1 | FAP_1 |
| MMP1_1 | 0.336 | 0.3333 | 0.3281 |
| MMP2_2 | SOD2_1 | IGFBP5_1 | TIMP2_1 |
| MMP2_2 | 0.6164 | 0.6159 | 0.6096 |
| MSH2_3 | RAF1_3 | FBXO5_1 | CCNB1_2 |
| MSH2_3 | 0.3102 | 0.3091 | 0.3083 |
| MSH3_2 | TP53BP2_2 | ITGB1_1 | EFP_3 |
| MSH3_2 | 0.2682 | 0.2659 | 0.2658 |
| NR4A1_1 | PAI1_3 | THBS1_1 | INHBA_1 |
| NR4A1_1 | 0.3396 | 0.318 | 0.2957 |
| NRP1_1 | PAI1_3 | IGFBP7_1 | ANXA5_1 |
| NRP1_1 | 0.556 | 0.5447 | 0.5423 |
| PDGFA_3 | STMY3_3 | CRYAB_1 | MYLK_1 |
| PDGFA_3 | 0.3279 | 0.3255 | 0.3217 |
| PDGFC_3 | TGFB3_1 | INHBA_1 | TIMP3_3 |
| PDGFC_3 | 0.6111 | 0.6108 | 0.6098 |
| PDGFD_2 | MYLK_1 | TGFB3_1 | IGFBP5_1 |
| PDGFD_2 | 0.3765 | 0.3705 | 0.3678 |
| PDGFRA_2 | VIM_3 | NRP1_1 | TIMP2_1 |
| PDGFRA_2 | 0.4821 | 0.4776 | 0.4692 |
| PFN2_1 | TP53BP2_2 | BAD_1 | HSPE1_1 |
| PFN2_1 | 0.2737 | 0.2731 | 0.2691 |
| PKR2_1 | AXIN_2_3 | HIF1A_3 | CTSL_2 |
| PKR2_1 | −0.4449 | 0.4442 | 0.4435 |
| PRDX2_1 | TIMP3_3 | ANTXR1_1 | UBB_1 |
| PRDX2_1 | −0.3171 | −0.3086 | 0.3085 |
| RAB32_1 | ID3_2 | GSK3B_2 | IGFBP7_1 |
| RAB32_1 | 0.3219 | 0.3192 | 0.3176 |
| RAD54L_1 | ESPL1_3 | PLK_3 | SURV_2 |

TABLE C-continued

| | | | |
|---|---|---|---|
| RAD54L_1 | 0.4104 | 0.4095 | 0.4057 |
| RANBP2_3 | RAF1_3 | HDAC1_1 | APC_4 |
| RANBP2_3 | 0.335 | 0.3297 | 0.3282 |
| RCC1_1 | RAD54L_1 | PCNA_2 | LMNB1_1 |
| RCC1_1 | 0.4006 | 0.3966 | 0.3942 |
| RHOB_1 | CDC2_1 | MAD2L1_1 | TIMP2_1 |
| RHOB_1 | −0.3711 | −0.3705 | 0.3565 |
| ROCK2_1 | CLAUDIN_4_2 | PTP4A3_V2_1 | TGFBI_1 |
| ROCK2_1 | 0.3242 | 0.3235 | 0.3231 |
| RUNX1_2 | SFRP4_1 | COL1A2_1 | CTHRC1_1 |
| RUNX1_2 | 0.4921 | 0.4883 | 0.4825 |
| S100P_1 | MRP3_1 | SLPI_1 | APG_1_1 |
| S100P_1 | 0.2664 | 0.2655 | 0.257 |
| SAT_1 | CTSL_2 | BGN_1 | CAD17_1 |
| SAT_1 | 0.275 | 0.2684 | −0.2621 |
| SEMA4B_1 | EGLN3_1 | P21_3 | PS2_2 |
| SEMA4B_1 | 0.387 | 0.3866 | 0.3864 |
| SIAT4A_2 | TGFB3_1 | HSPG2_1 | ITGA5_1 |
| SIAT4A_2 | 0.4121 | 0.4082 | 0.3906 |
| SKP2_1 | RAD54L_1 | TS_1 | CCNB1_2 |
| SKP2_1 | 0.3407 | 0.3348 | 0.3306 |
| SOD1_1 | CD44V6_1 | TMEPAI_1 | HOXB7_1 |
| SOD1_1 | 0.2471 | −0.2457 | 0.233 |
| SOS1_1 | ANTXR1_1 | TGFBR2_3 | FAP_1 |
| SOS1_1 | 0.2542 | 0.2537 | 0.253 |
| SPARC_1 | MMP2_2 | THBS1_1 | ANTXR1_1 |
| SPARC_1 | 0.7229 | 0.7207 | 0.7138 |
| SPRY1_1 | VIM_3 | SPARC_1 | TIMP1_3 |
| SPRY1_1 | 0.4162 | 0.4152 | 0.4138 |
| SPRY2_2 | GSK3B_2 | TGFBI_1 | LEF_1 |
| SPRY2_2 | 0.3297 | 0.3209 | 0.315 |
| STK15_2 | DLC1_1 | CMYC_3 | FAP_1 |
| STK15_2 | −0.3935 | 0.3913 | −0.3863 |
| TCF_1_1 | AXIN1_1 | E2F1_3 | ANXA1_2 |
| TCF_1_1 | 0.3518 | 0.3493 | −0.3475 |
| THBS1_1 | TIMP1_3 | TLN1_1 | UPA_3 |
| THBS1_1 | 0.6534 | 0.64 | 0.639 |
| TIMP1_3 | VIM_3 | TIMP2_1 | PAI1_3 |
| TIMP1_3 | 0.611 | 0.6022 | 0.6019 |
| TOP2A_4 | MCM3_3 | RRM2_1 | CDC2_1 |
| TOP2A_4 | 0.39 | 0.3887 | 0.3809 |
| TP53BP1_2 | RBX1_1 | ITGAV_1 | MGAT5_1 |
| TP53BP1_2 | 0.3098 | 0.3095 | 0.309 |
| UBE2C_1 | HSPE1_1 | P21_3 | AREG_2 |
| UBE2C_1 | 0.3561 | −0.3471 | 0.3458 |
| UPP1_1 | TMSB10_1 | UPA_3 | CAPG_1 |
| UPP1_1 | 0.3279 | 0.3277 | 0.3228 |
| VCP_1 | KRT8_3 | SNRPF_2 | PCNA_2 |
| VCP_1 | 0.4132 | 0.4076 | 0.4072 |
| VDAC2_1 | ENO1_1 | CCNA2_1 | DHFR_2 |
| VDAC2_1 | 0.3445 | 0.3424 | 0.3417 |

| Variable | out16 | out17 | out18 |
|---|---|---|---|
| AMFR_1 | KLF6_1 | GIT1_1 | TAGLN_3 |
| AMFR_1 | 0.2544 | 0.2544 | 0.2535 |
| ANXA1_2 | MCP1_1 | ITGA5_1 | CXCR4_3 |
| ANXA1_2 | 0.4655 | 0.4562 | 0.454 |
| APC_4 | CXCL12_1 | CALD1_2 | MMP2_2 |
| APC_4 | 0.3023 | 0.2994 | 0.2911 |
| AURKB_1 | CENPA_1 | KIF22_1 | CDC2_1 |
| AURKB_1 | 0.3884 | 0.3818 | 0.3799 |
| AXIN_2_3 | TMEPAI_1 | ABCB1_5 | AREG_2 |
| AXIN_2_3 | 0.3947 | 0.3925 | 0.3911 |
| BGN_1 | ADAMTS12_1 | LOX_1 | CTGF_1 |
| BGN_1 | 0.6962 | 0.695 | 0.6912 |
| BIK_1 | KCNH2_ISO_A_C_1 | EREG_1 | S100P_1 |
| BIK_1 | −0.2293 | −0.2235 | 0.2117 |
| BRAF_5 | TP53BP2_2 | CHFR_1 | MGAT5_1 |
| BRAF_5 | 0.3307 | 0.3257 | 0.3249 |
| BRAF_SNP1_6 | ABCB1_5 | NKD_1_1 | EPHB6_1 |
| BRAF_SNP1_6 | −0.3041 | −0.304 | 0.3038 |
| BRCA2_2 | RRM1_2 | SKP2_1 | CRIPTO_TDGF1_OFFICIAL_1 |
| BRCA2_2 | 0.1949 | 0.1895 | 0.1884 |
| BUB1_1 | TGFBR2_3 | RRM2_1 | CCNB1_2 |
| BUB1_1 | −0.4559 | 0.4494 | 0.4432 |
| B_CATENIN_3 | C_SRC_1 | TCF_1_1 | TGFBI_1 |
| B_CATENIN_3 | 0.3261 | 0.3253 | 0.3177 |
| C20ORF126_1 | ANXA2_2 | STK15_2 | P21_3 |
| C20ORF126_1 | −0.3807 | 0.3739 | −0.3673 |

TABLE C-continued

| Gene | Value | Gene | Value | Gene | Value | Gene | Value |
|---|---|---|---|---|---|---|---|
| C20_ORF1_1 | | DAPK1_3 | −0.3821 | RALBP1_1 | −0.3793 | CENPF_1 | 0.3773 |
| CALD1_2 | 0.6219 | TLN1_1 | 0.6208 | TGFB3_1 | | THBS1_1 | 0.6188 |
| CASP9_1 | −0.1815 | CDC6_1 | 0.1811 | PTGER3_1 | | CRYAB_1 | 0.181 |
| CCNE2_2 | −0.2915 | WISP1_1 | −0.2898 | HSPG2_1 | | NRP2_2 | −0.2801 |
| CCNE2_VARIANT_1_1 | 0.2926 | MSH2_3 | 0.2922 | HNRPAB_3 | | EFP_3 | 0.2868 |
| CD44E_1 | 0.3582 | VEGF_ALTSPLICE2_1 | 0.3576 | TP53BP2_2 | | CMYC_3 | 0.3463 |
| CD44S_1 | 0.5456 | CD18_2 | 0.5451 | NRP2_2 | | BGN_1 | 0.5448 |
| CD44V6_1 | 0.3225 | ODC1_3 | 0.3161 | RRM2_1 | | PKR2_1 | 0.3123 |
| CD68_2 | 0.4557 | GBP2_2 | 0.4557 | UPA_3 | | TIMP1_3 | 0.4491 |
| CDC2_1 | 0.4685 | RRM2_1 | 0.4653 | STK15_2 | | SNRPF_2 | 0.4625 |
| CDC4_1 | 0.2432 | MMP2_2 | 0.2425 | SGCB_1 | | P53R2_3 | 0.2415 |
| CDH11_1 | 0.6494 | COL1A1_1 | 0.647 | ADAMTS12_1 | | TIMP1_3 | 0.6452 |
| CDX2_3 | −0.4216 | MASPIN_2 | −0.4153 | CTSB_1 | | CDH1_INTRON_2_2 | 0.409 |
| CENPA_1 | 0.3187 | UBE2C_1 | −0.3045 | PDGFC_3 | | CENPF_1 | 0.3016 |
| CENPF_1 | 0.3947 | CDC25C_1 | 0.3834 | KI_67_2 | | FBXO5_1 | 0.3819 |
| CHFR_1 | 0.3421 | PTCH_1 | 0.3348 | AKT3_2 | | ITGB3_1 | 0.3346 |
| CHK1_2 | 0.3744 | TS_1 | 0.3739 | MCM3_3 | | CDC6_1 | 0.3707 |
| CLDN1_1 | 0.2159 | VEGF_ALTSPLICE2_1 | 0.2141 | AXIN_2_3 | | C20ORF126_1 | 0.2128 |
| CLIC1_1 | 0.3093 | C_MYB_MYB_OFFICIAL_1 | 0.3091 | HER2_3 | | TMSB10_1 | 0.309 |
| CLTC_1 | 0.2558 | TLN1_1 | 0.2554 | RHOC_1 | | NOTCH1_1 | 0.2509 |
| CMYC_3 | 0.3984 | MAD2L1_1 | 0.3913 | STK15_2 | | CMET_2 | 0.3894 |
| COL1A1_1 | 0.6494 | CDH11_1 | 0.6306 | TIMP3_3 | | PDGFC_3 | 0.6281 |
| COL1A2_1 | 0.6673 | TAGLN_3 | 0.6601 | NRP2_2 | | SFRP2_1 | 0.6536 |
| CREBBP_1 | 0.2981 | VEGF_ALTSPLICE2_1 | 0.2981 | HOXA5_1 | | MYLK_1 | 0.2954 |
| CTSB_1 | 0.507 | CXCL12_1 | 0.5067 | INHBA_1 | | TIMP2_1 | 0.5016 |
| CTSL_2 | 0.5937 | MCP1_1 | 0.5926 | CTSB_1 | | OPN_OSTEOPONTIN_3 | 0.5915 |
| CXCL12_1 | 0.574 | IGF1_2 | 0.5731 | THBS1_1 | | DLC1_1 | 0.5611 |
| CYR61_1 | 0.5487 | DLC1_1 | 0.5467 | EGR1_1 | | BGN_1 | 0.5458 |
| DLC1_1 | 0.5816 | COL1A1_1 | 0.577 | SFRP2_1 | | ADAMTS12_1 | 0.5642 |
| DUSP1_1 | 0.4982 | SPARC_1 | 0.4901 | COL1A2_1 | | KLF6_1 | 0.4868 |
| E2F1_3 | 0.3498 | EREG_1 | 0.3493 | TCF_1_1 | | CTSB_1 | −0.3492 |
| EFNB2_1 | 0.3031 | LAMA3_1 | 0.3014 | KRT8_3 | | CUL4A_1 | 0.2961 |
| EGR3_1 | 0.3067 | COL1A1_1 | 0.3004 | CXCL12_1 | | KLF6_1 | 0.2997 |
| EI24_1 | 0.28 | ODC1_3 | 0.278 | MCM3_3 | | KLF5_1 | 0.2735 |
| ENO1_1 | 0.4037 | TS_1 | 0.3952 | SURV_2 | | EIF4E_1 | 0.395 |
| EPAS1_1 | 0.4635 | TGFBR1_1 | 0.463 | IGFBP5_1 | | ITGB3_1 | 0.4622 |
| ESPL1_3 | 0.3665 | RCC1_1 | 0.3627 | MAD2L1_1 | | TS_1 | 0.356 |
| FBXO5_1 | 0.3335 | TP53BP2_2 | 0.333 | SURV_2 | | CDC2_1 | 0.3287 |
| FGF18_2 | 0.2553 | BRAF_5 | 0.2532 | SFRP4_1 | | BGN_1 | 0.253 |
| FGF2_2 | 0.2928 | NRP2_2 | 0.2855 | DLC1_1 | | IGFBP7_1 | 0.2841 |

TABLE C-continued

| | | | |
|---|---|---|---|
| FOS__1 | CXCL12__1 | EMP1__1 | DLC1__1 |
| FOS__1 | 0.3614 | 0.3524 | 0.3491 |
| FOXO3A__1 | CMYC__3 | STMY3__3 | LRP5__1 |
| FOXO3A__1 | 0.387 | 0.3786 | 0.3785 |
| FPGS__1 | RAF1__3 | HOXA5__1 | NEDD8__2 |
| FPGS__1 | 0.252 | 0.2512 | 0.2493 |
| FST__1 | AKAP12__2 | FABP4__1 | INHBA__1 |
| FST__1 | 0.3468 | 0.3372 | 0.3353 |
| FZD1__1 | IGFBP5__1 | THBS1__1 | AKT3__2 |
| FZD1__1 | 0.5304 | 0.5254 | 0.5202 |
| GJB2__1 | LOXL2__1 | CDH11__1 | CTHRC1__1 |
| GJB2__1 | 0.4622 | 0.4508 | 0.4475 |
| GPX1__2 | UNC5B__1 | ANTXR1__1 | PLK3__1 |
| GPX1__2 | 0.3585 | 0.3426 | 0.3404 |
| GRB10__1 | DLC1__1 | IGFBP3__3 | TGFB3__1 |
| GRB10__1 | 0.2041 | 0.2028 | 0.2026 |
| GSK3B__2 | KLF5__1 | VEGFB__1 | GIT1__1 |
| GSK3B__2 | 0.3724 | 0.3711 | 0.3639 |
| HES6__1 | SURV__2 | CEBPB__1 | TCF__1__1 |
| HES6__1 | 0.2898 | −0.2843 | 0.2824 |
| HIF1A__3 | COL1A2__1 | SNAI2__1 | CXCL12__1 |
| HIF1A__3 | 0.478 | 0.4749 | 0.4727 |
| HLA_G__2 | UPP1__1 | GPX1__2 | CXCL12__1 |
| HLA_G__2 | 0.0928 | 0.0923 | 0.0919 |
| HNRPAB__3 | GPX1__2 | THY1__1 | MCM6__3 |
| HNRPAB__3 | −0.3917 | −0.3892 | 0.3728 |
| HNRPD__1 | ST14__1 | AURKB__1 | GPX1__2 |
| HNRPD__1 | 0.3189 | 0.3142 | 0.3129 |
| HOXA5__1 | ITGAV__1 | FPGS__1 | NME1__3 |
| HOXA5__1 | 0.2542 | 0.2512 | −0.25 |
| HOXB13__1 | BRCA1__2 | PI3K__2 | CTSB__1 |
| HOXB13__1 | 0.1477 | 0.1475 | −0.1472 |
| HSD17B2__1 | CRIPTO_TDGF1_OFFICIAL__1 | KRT8__3 | LGALS3__1 |
| HSD17B2__1 | −0.3206 | 0.3193 | 0.3131 |
| HSPA1A__1 | WISP1__1 | ITGB1__1 | LOXL2__1 |
| HSPA1A__1 | 0.3435 | 0.3426 | 0.3347 |
| HSPA1B__1 | CDC2__1 | VEGF_ALTSPLICE1__1 | NR4A1__1 |
| HSPA1B__1 | 0.1862 | 0.186 | 0.1761 |
| HSPE1__1 | CCNE2_VARIANT_1__1 | CSEL1__1 | HSPG2__1 |
| HSPE1__1 | 0.3882 | 0.3881 | −0.3878 |
| IGFBP3__3 | AKT3__2 | WISP1__1 | ITGB1__1 |
| IGFBP3__3 | 0.4539 | 0.4518 | 0.4444 |
| IGFBP5__1 | THBS1__1 | TGFB3__1 | MMP2__2 |
| IGFBP5__1 | 0.6177 | 0.6165 | 0.6159 |
| IGFBP7__1 | VEGFB__1 | COL1A2__1 | TIMP1__3 |
| IGFBP7__1 | 0.6369 | 0.616 | 0.6157 |
| IL6ST__3 | MYH11__1 | FZD1__1 | TIMP3__3 |
| IL6ST__3 | 0.439 | 0.4346 | 0.4307 |
| KI_67__2 | PCNA__2 | KIF22__1 | CDC25C__1 |
| KI_67__2 | 0.4482 | 0.4417 | 0.4369 |
| KIF22__1 | SURV__2 | AURKB__1 | TK1__2 |
| KIF22__1 | 0.3909 | 0.3818 | 0.3733 |
| KIFC1__1 | CDC25C__1 | NEK2__1 | SURV__2 |
| KIFC1__1 | 0.404 | 0.4033 | 0.3998 |
| KLF5__1 | AXIN1__1 | B_CATENIN__3 | ST14__1 |
| KLF5__1 | 0.3818 | 0.38 | 0.3783 |
| KLK10__3 | E2F1__3 | CDCA7_V2__1 | F3__1 |
| KLK10__3 | −0.3127 | −0.3053 | 0.3039 |
| KLK6__1 | CDC25C__1 | EPHB6__1 | CAD17__1 |
| KLK6__1 | −0.2255 | 0.2251 | −0.2134 |
| KLRK1__2 | FYN__3 | DPYD__2 | CD68__2 |
| KLRK1__2 | 0.3098 | 0.3097 | 0.309 |
| KRT8__3 | H2AFZ__2 | UPP1__1 | SBA2__1 |
| KRT8__3 | 0.3828 | 0.381 | 0.378 |
| LAT__1 | ANXA5__1 | CDH11__1 | MYLK__1 |
| LAT__1 | 0.3487 | 0.3424 | 0.3366 |
| LEF__1 | MYH11__1 | DLC1__1 | THY1__1 |
| LEF__1 | 0.4157 | 0.4014 | 0.3957 |
| LMYC__2 | ITGA5__1 | SOD2__1 | CDC42BPA__1 |
| LMYC__2 | 0.3059 | 0.2981 | 0.2931 |
| LOXL2__1 | LOX__1 | TGFB3__1 | PDGFC__3 |
| LOXL2__1 | 0.5981 | 0.5957 | 0.5923 |
| LOX__1 | WISP1__1 | PAI1__3 | CTHRC1__1 |
| LOX__1 | 0.5504 | 0.5407 | 0.5365 |
| MAD2L1__1 | TGFBR2__3 | KRT8__3 | PCNA__2 |
| MAD2L1__1 | −0.4486 | 0.4427 | 0.4403 |
| MADH7__1 | SPARC__1 | THBS1__1 | COL1A2__1 |
| MADH7__1 | 0.4336 | 0.43 | 0.4249 |
| MASPIN__2 | MADH2__1 | S100P__1 | PTP4A3_V2__1 |
| MASPIN__2 | 0.3679 | 0.3674 | −0.3648 |

TABLE C-continued

| | | | |
|---|---|---|---|
| MCM3_3 | CDC25C_1 | LMNB1_1 | CENPF_1 |
| MCM3_3 | 0.4058 | 0.4042 | 0.3979 |
| MCP1_1 | WISP1_1 | INHBA_1 | IGFBP5_1 |
| MCP1_1 | 0.5532 | 0.5514 | 0.5511 |
| MMP1_1 | TIMP1_3 | TP_3 | ITGAV_1 |
| MMP1_1 | 0.3168 | 0.3146 | 0.3087 |
| MMP2_2 | CTGF_1 | IGFBP7_1 | CTSL_2 |
| MMP2_2 | 0.6026 | 0.5986 | 0.5971 |
| MSH2_3 | VEGF_ALTSPLICE2_1 | ODC1_3 | CCNE2_VARIANT_1_1 |
| MSH2_3 | 0.3027 | 0.297 | 0.2926 |
| MSH3_2 | TLN1_1 | APC_4 | CLIC1_1 |
| MSH3_2 | 0.2634 | 0.2603 | 0.2594 |
| NR4A1_1 | EMP1_1 | DLC1_1 | CXCR4_3 |
| NR4A1_1 | 0.293 | 0.2866 | 0.276 |
| NRP1_1 | SNAI2_1 | CDH11_1 | CD18_2 |
| NRP1_1 | 0.5377 | 0.5303 | 0.5172 |
| PDGFA_3 | ENO1_1 | CEBPB_1 | TGFBR1_1 |
| PDGFA_3 | −0.3194 | 0.3184 | 0.3153 |
| PDGFC_3 | ADAMTS12_1 | CTHRC1_1 | WISP1_1 |
| PDGFC_3 | 0.6089 | 0.6067 | 0.606 |
| PDGFD_2 | OSMR_1 | CXCL12_1 | VIM_3 |
| PDGFD_2 | 0.3668 | 0.3589 | 0.3581 |
| PDGFRA_2 | TLN1_1 | DPYD_2 | CTGF_1 |
| PDGFRA_2 | 0.4679 | 0.4672 | 0.4666 |
| PFN2_1 | TAGLN_3 | SNRPF_2 | ITGA5_1 |
| PFN2_1 | 0.2662 | 0.2662 | 0.2653 |
| PKR2_1 | EGLN3_1 | P21_3 | OPN_OSTEOPONTIN_3 |
| PKR2_1 | 0.4308 | 0.4307 | 0.4289 |
| PRDX2_1 | MCM2_2 | STK15_2 | MCM3_3 |
| PRDX2_1 | 0.3033 | 0.3021 | 0.301 |
| RAB32_1 | TAGLN_3 | CDH11_1 | THBS1_1 |
| RAB32_1 | 0.3161 | 0.3145 | 0.3133 |
| RAD54L_1 | CDC6_1 | AURKB_1 | MAD2L1_1 |
| RAD54L_1 | 0.4051 | 0.4048 | 0.4022 |
| RANBP2_3 | MGAT5_1 | TP53BP2_2 | K_RAS_10 |
| RANBP2_3 | 0.324 | 0.32 | 0.3199 |
| RCC1_1 | NEK2_1 | SNRPF_2 | UBE2M_2 |
| RCC1_1 | 0.3887 | 0.3843 | 0.3837 |
| RHOB_1 | CDC42BPA_1 | ITGB1_1 | ITGB3_1 |
| RHOB_1 | 0.3535 | 0.3452 | 0.3446 |
| ROCK2_1 | RHOB_1 | APG_1_1 | MGAT5_1 |
| ROCK2_1 | 0.314 | −0.3033 | 0.3001 |
| RUNX1_2 | FAP_1 | WISP1_1 | TGFB3_1 |
| RUNX1_2 | 0.482 | 0.4783 | 0.4743 |
| S100P_1 | EGLN3_1 | LGALS3_1 | EREG_1 |
| S100P_1 | 0.257 | 0.2484 | −0.2478 |
| SAT_1 | C20ORF126_1 | TLN1_1 | ENO1_1 |
| SAT_1 | −0.2575 | 0.2544 | 0.2533 |
| SEMA4B_1 | CDX2_3 | PLK3_1 | LAMA3_1 |
| SEMA4B_1 | −0.3826 | 0.3781 | 0.3748 |
| SIAT4A_2 | PLK3_1 | LOX_1 | SFRP2_1 |
| SIAT4A_2 | 0.3905 | 0.3896 | 0.386 |
| SKP2_1 | C_MYB_MYB_OFFICIAL_1 | C20_ORF1_1 | ODC1_3 |
| SKP2_1 | 0.3291 | 0.3278 | 0.3224 |
| SOD1_1 | EI24_1 | REG4_1 | VDAC2_1 |
| SOD1_1 | 0.2277 | 0.2251 | 0.2227 |
| SOS1_1 | BRAF_5 | TIMP3_3 | CDC2_1 |
| SOS1_1 | 0.2524 | 0.2512 | −0.2507 |
| SPARC_1 | TGFB3_1 | TIMP1_3 | SFRP2_1 |
| SPARC_1 | 0.7095 | 0.7068 | 0.6994 |
| SPRY1_1 | FYN_3 | ITGA5_1 | BAD_1 |
| SPRY1_1 | 0.4125 | 0.4124 | 0.4051 |
| SPRY2_2 | PI3K_2 | CUL4A_1 | KCNH2_ISO_A_C_1 |
| SPRY2_2 | 0.3058 | 0.2969 | 0.2923 |
| STK15_2 | TIMP2_1 | KI_67_2 | MAD2L1_1 |
| STK15_2 | −0.383 | 0.3814 | 0.3755 |
| TCF_1_1 | C_SRC_1 | CMYC_3 | VCP_1 |
| TCF_1_1 | 0.3456 | 0.3445 | 0.3407 |
| THBS1_1 | CTSL_2 | BGN_1 | CALD1_2 |
| THBS1_1 | 0.636 | 0.6323 | 0.6188 |
| TIMP1_3 | UPA_3 | MMP2_2 | INHBA_1 |
| TIMP1_3 | 0.6013 | 0.5962 | 0.5947 |
| TOP2A_4 | CHK1_2 | RRM1_2 | CDC20_1 |
| TOP2A_4 | 0.3791 | 0.3743 | 0.3724 |
| TP53BP1_2 | AKT3_2 | RAF1_3 | MADH2_1 |
| TP53BP1_2 | 0.3051 | 0.304 | 0.2951 |
| UBE2C_1 | BUB1_1 | KIFC1_1 | CENPF_1 |
| UBE2C_1 | 0.3373 | 0.3316 | 0.3286 |
| UPP1_1 | CD18_2 | ANXA5_1 | ENO1_1 |
| UPP1_1 | 0.3165 | 0.3116 | 0.306 |

TABLE C-continued

| | | | |
|---|---|---|---|
| VCP__1 | SLC31A1__1 | IRS1__3 | NEDD8__2 |
| VCP__1 | 0.4012 | 0.3904 | −0.388 |
| VDAC2__1 | DR4__2 | CD44V6__1 | MADH4__1 |
| VDAC2__1 | 0.3343 | 0.3094 | 0.3017 |

| Variable | out19 | out20 | __lstyle |
|---|---|---|---|
| AMFR__1 | FOXO3A__1 | CHFR__1 | 1 |
| AMFR__1 | 0.2517 | 0.2474 | 2 |
| ANXA1__2 | INHBA__1 | WISP1__1 | 1 |
| ANXA1__2 | 0.4527 | 0.4497 | 2 |
| APC__4 | EPAS1__1 | VIM__3 | 1 |
| APC__4 | 0.29 | 0.2884 | 2 |
| AURKB__1 | TK1__2 | C20__ORF1__1 | 1 |
| AURKB__1 | 0.3724 | 0.3655 | 2 |
| AXIN__2__3 | CTSL__2 | TGFBI__1 | 1 |
| AXIN__2__3 | −0.3853 | 0.3851 | 2 |
| BGN__1 | CXCL12__1 | PDGFC__3 | 1 |
| BGN__1 | 0.6838 | 0.6788 | 2 |
| BIK__1 | APG__1__1 | EGLN3__1 | 1 |
| BIK__1 | 0.2115 | 0.211 | 2 |
| BRAF__5 | GCNT1__1 | TLN1__1 | 1 |
| BRAF__5 | 0.324 | 0.323 | 2 |
| BRAF__SNP1__6 | EREG__1 | ROCK2__1 | 1 |
| BRAF__SNP1__6 | −0.2893 | −0.289 | 2 |
| BRCA2__2 | VEGF__ALTSPLICE2__1 | AURKB__1 | 1 |
| BRCA2__2 | 0.1879 | 0.1843 | 2 |
| BUB1__1 | ENO1__1 | CENPA__1 | 1 |
| BUB1__1 | 0.4408 | 0.4355 | 2 |
| B_CATENIN__3 | TP53BP1__2 | AXIN1__1 | 1 |
| B_CATENIN__3 | 0.3149 | 0.313 | 2 |
| C20ORF126__1 | AXIN__2__3 | CDX2__3 | 1 |
| C20ORF126__1 | 0.3655 | 0.3627 | 2 |
| C20__ORF1__1 | REG4__1 | PS2__2 | 1 |
| C20__ORF1__1 | −0.3736 | −0.3674 | 2 |
| CALD1__2 | AKT3__2 | CTGF__1 | 1 |
| CALD1__2 | 0.6145 | 0.595 | 2 |
| CASP9__1 | VEGFB__1 | CCNA2__1 | 1 |
| CASP9__1 | 0.1781 | −0.177 | 2 |
| CCNE2__2 | CHK1__2 | NEDD8__2 | 1 |
| CCNE2__2 | 0.28 | 0.2792 | 2 |
| CCNE2__VARIANT__1__1 | CDC2__1 | MCM6__3 | 1 |
| CCNE2__VARIANT__1__1 | 0.2859 | 0.2858 | 2 |
| CD44E__1 | MAD2L1__1 | EIF4E__1 | 1 |
| CD44E__1 | 0.3318 | 0.3287 | 2 |
| CD44S__1 | CD68__2 | SPARC__1 | 1 |
| CD44S__1 | 0.534 | 0.5297 | 2 |
| CD44V6__1 | EGLN3__1 | SLC25A3__2 | 1 |
| CD44V6__1 | 0.3118 | 0.3111 | 2 |
| CD68__2 | FYN__3 | SNAI2__1 | 1 |
| CD68__2 | 0.449 | 0.448 | 2 |
| CDC2__1 | PCNA__2 | CDC25C__1 | 1 |
| CDC2__1 | 0.4446 | 0.4376 | 2 |
| CDC4__1 | PI3K__2 | RANBP2__3 | 1 |
| CDC4__1 | 0.2412 | 0.2387 | 2 |
| CDH11__1 | VIM__3 | CTGF__1 | 1 |
| CDH11__1 | 0.6376 | 0.6355 | 2 |
| CDX2__3 | CD24__1 | CMYC__3 | 1 |
| CDX2__3 | 0.4051 | 0.3997 | 2 |
| CENPA__1 | MMP2__2 | CYR61__1 | 1 |
| CENPA__1 | −0.3012 | −0.2973 | 2 |
| CENPF__1 | C20__ORF1__1 | MCM2__2 | 1 |
| CENPF__1 | 0.3773 | 0.3693 | 2 |
| CHFR__1 | VIM__3 | CXCL12__1 | 1 |
| CHFR__1 | 0.3306 | 0.3296 | 2 |
| CHK1__2 | SLC25A3__2 | C_MYB_MYB_OFFICIAL__1 | 1 |
| CHK1__2 | 0.3672 | 0.3641 | 2 |
| CLDN1__1 | CLIC1__1 | EFNB2__1 | 1 |
| CLDN1__1 | 0.2119 | 0.211 | 2 |
| CLIC1__1 | HCRA_A__2 | FOXO3A__1 | 1 |
| CLIC1__1 | 0.3081 | 0.3081 | 2 |
| CLTC__1 | UNC5B__1 | DLC1__1 | 1 |
| CLTC__1 | 0.24 | 0.2399 | 2 |
| CMYC__3 | ODC1__3 | C_MYB_MYB_OFFICIAL__1 | 1 |
| CMYC__3 | 0.3882 | 0.3876 | 2 |
| COL1A1__1 | CXCL12__1 | HSPG2__1 | 1 |
| COL1A1__1 | 0.6206 | 0.608 | 2 |
| COL1A2__1 | TIMP1__3 | ADAMTS12__1 | 1 |
| COL1A2__1 | 0.6518 | 0.6393 | 2 |
| CREBBP__1 | KLF5__1 | HCRA_A__2 | 1 |

TABLE C-continued

| | | | |
|---|---|---|---|
| CREBBP_1 | 0.2953 | 0.2924 | 2 |
| CTSB_1 | SFRP2_1 | MCP1_1 | 1 |
| CTSB_1 | 0.5015 | 0.4946 | 2 |
| CTSL_2 | NRP2_2 | SPARC_1 | 1 |
| CTSL_2 | 0.5813 | 0.5694 | 2 |
| CXCL12_1 | TLN1_1 | CD44S_1 | 1 |
| CXCL12_1 | 0.5583 | 0.5556 | 2 |
| CYR61_1 | MCP1_1 | WISP1_1 | 1 |
| CYR61_1 | 0.5436 | 0.5373 | 2 |
| DLC1_1 | IGFBP7_1 | CXCL12_1 | 1 |
| DLC1_1 | 0.564 | 0.5611 | 2 |
| DUSP1_1 | BGN_1 | EPAS1_1 | 1 |
| DUSP1_1 | 0.4773 | 0.4739 | 2 |
| E2F1_3 | FAP_1 | TOP2A_4 | 1 |
| E2F1_3 | −0.3434 | 0.3391 | 2 |
| EFNB2_1 | CLAUDIN_4_2 | B_CATENIN_3 | 1 |
| EFNB2_1 | 0.2958 | 0.2939 | 2 |
| EGR3_1 | EMP1_1 | BGN_1 | 1 |
| EGR3_1 | 0.2978 | 0.2937 | 2 |
| EI24_1 | RRM2_1 | HRAS_1 | 1 |
| EI24_1 | 0.2724 | 0.2714 | 2 |
| ENO1_1 | HNRPD_1 | CCNB1_2 | 1 |
| ENO1_1 | 0.3931 | 0.3914 | 2 |
| EPAS1_1 | COL1A2_1 | CALD1_2 | 1 |
| EPAS1_1 | 0.4607 | 0.4565 | 2 |
| ESPL1_3 | PCNA_2 | C20_ORF1_1 | 1 |
| ESPL1_3 | 0.3534 | 0.3518 | 2 |
| FBXO5_1 | MCM6_3 | MYBL2_1 | 1 |
| FBXO5_1 | 0.3234 | 0.3196 | 2 |
| FGF18_2 | DLC1_1 | TGFB2_2 | 1 |
| FGF18_2 | 0.25 | 0.2485 | 2 |
| FGF2_2 | ITGA5_1 | ITGB1_1 | 1 |
| FGF2_2 | 0.2812 | 0.2811 | 2 |
| FOS_1 | VCL_1 | CXCR4_3 | 1 |
| FOS_1 | 0.3409 | 0.3385 | 2 |
| FOXO3A_1 | GSTP_3 | THBS1_1 | 1 |
| FOXO3A_1 | 0.3775 | 0.3766 | 2 |
| FPGS_1 | CMYC_3 | ANXA1_2 | 1 |
| FPGS_1 | −0.2475 | 0.2404 | 2 |
| FST_1 | IGFBP3_3 | CYR61_1 | 1 |
| FST_1 | 0.3352 | 0.333 | 2 |
| FZD1_1 | CTGF_1 | RUNX1_2 | 1 |
| FZD1_1 | 0.5168 | 0.5114 | 2 |
| GJB2_1 | FAP_1 | SNAI2_1 | 1 |
| GJB2_1 | 0.4401 | 0.434 | 2 |
| GPX1_2 | TGFB3_1 | TP_3 | 1 |
| GPX1_2 | 0.3396 | 0.3357 | 2 |
| GRB10_1 | HSPE1_1 | SURV_2 | 1 |
| GRB10_1 | −0.2017 | −0.1994 | 2 |
| GSK3B_2 | TAGLN_3 | SNRPF_2 | 1 |
| GSK3B_2 | 0.362 | 0.3592 | 2 |
| HES6_1 | NOTCH1_1 | H2AFZ_2 | 1 |
| HES6_1 | 0.28 | 0.2748 | 2 |
| HIF1A_3 | ROCK1_1 | RBX1_1 | 1 |
| HIF1A_3 | 0.4665 | 0.4646 | 2 |
| HLA_G_2 | C20ORF126_1 | TGFBR1_1 | 1 |
| HLA_G_2 | −0.0903 | 0.088 | 2 |
| HNRPAB_3 | ITGAV_1 | HSPG2_1 | 1 |
| HNRPAB_3 | 0.3664 | −0.3644 | 2 |
| HNRPD_1 | ESPL1_3 | BUB1_1 | 1 |
| HNRPD_1 | 0.3115 | 0.3105 | 2 |
| HOXA5_1 | RANBP2_3 | MADH4_1 | 1 |
| HOXA5_1 | 0.2467 | 0.2441 | 2 |
| HOXB13_1 | KLF5_1 | BAX_1 | 1 |
| HOXB13_1 | 0.1469 | 0.1436 | 2 |
| HSD17B2_1 | S100P_1 | EREG_1 | 1 |
| HSD17B2_1 | 0.3061 | −0.306 | 2 |
| HSPA1A_1 | CD44S_1 | SFRP2_1 | 1 |
| HSPA1A_1 | 0.3311 | 0.3267 | 2 |
| HSPA1B_1 | CMET_2 | CALD1_2 | 1 |
| HSPA1B_1 | 0.175 | −0.1705 | 2 |
| HSPE1_1 | CCNA2_1 | SURV_2 | 1 |
| HSPE1_1 | 0.3821 | 0.3774 | 2 |
| IGFBP3_3 | IGFBP7_1 | DLC1_1 | 1 |
| IGFBP3_3 | 0.4437 | 0.4437 | 2 |
| IGFBP5_1 | ANTXR1_1 | NRP2_2 | 1 |
| IGFBP5_1 | 0.6115 | 0.6101 | 2 |
| IGFBP7_1 | MMP2_2 | PDGFRA_2 | 1 |
| IGFBP7_1 | 0.5986 | 0.5972 | 2 |
| IL6ST_3 | ITGAV_1 | IGFBP5_1 | 1 |

TABLE C-continued

| | | | |
|---|---|---|---|
| IL6ST_3 | 0.426 | 0.4249 | 2 |
| KI_67_2 | VCP_1 | MCM3_3 | 1 |
| KI_67_2 | 0.4343 | 0.4331 | 2 |
| KIF22_1 | RCC1_1 | CENPA_1 | 1 |
| KIF22_1 | 0.3731 | 0.3575 | 2 |
| KIFC1_1 | ESPL1_3 | RRM2_1 | 1 |
| KIFC1_1 | 0.3996 | 0.3965 | 2 |
| KLF5_1 | PTCH_1 | GSK3B_2 | 1 |
| KLF5_1 | 0.3781 | 0.3724 | 2 |
| KLK10_3 | MYBL2_1 | CTSB_1 | 1 |
| KLK10_3 | −0.2978 | 0.291 | 2 |
| KLK6_1 | P14ARF_1 | CRIPTO_TDGF1_OFFICIAL_1 | 1 |
| KLK6_1 | 0.212 | −0.2119 | 2 |
| KLRK1_2 | EPHB2_1 | CCR7_1 | 1 |
| KLRK1_2 | −0.3045 | 0.3004 | 2 |
| KRT8_3 | CMET_2 | LAMC2_2 | 1 |
| KRT8_3 | 0.3738 | 0.3723 | 2 |
| LAT_1 | IGFBP5_1 | KLRK1_2 | 1 |
| LAT_1 | 0.3363 | 0.3333 | 2 |
| LEF_1 | NRP2_2 | TAGLN_3 | 1 |
| LEF_1 | 0.3855 | 0.3848 | 2 |
| LMYC_2 | COL1A2_1 | HIF1A_3 | 1 |
| LMYC_2 | 0.2863 | 0.2853 | 2 |
| LOXL2_1 | CALD1_2 | SFRP2_1 | 1 |
| LOXL2_1 | 0.5833 | 0.5714 | 2 |
| LOX_1 | CTGF_1 | VIM_3 | 1 |
| LOX_1 | 0.5297 | 0.5285 | 2 |
| MAD2L1_1 | CDC20_1 | RCC1_1 | 1 |
| MAD2L1_1 | 0.4398 | 0.434 | 2 |
| MADH7_1 | RUNX1_2 | INHBA_1 | 1 |
| MADH7_1 | 0.422 | 0.4169 | 2 |
| MASPIN_2 | EFNB2_1 | ATP5A1_1 | 1 |
| MASPIN_2 | 0.3621 | 0.3601 | 2 |
| MCM3_3 | TOP2A_4 | PLK_3 | 1 |
| MCM3_3 | 0.39 | 0.3864 | 2 |
| MCP1_1 | HIF1A_3 | CYR61_1 | 1 |
| MCP1_1 | 0.5464 | 0.5436 | 2 |
| MMP1_1 | LOXL2_1 | SPARC_1 | 1 |
| MMP1_1 | 0.3064 | 0.2972 | 2 |
| MMP2_2 | TIMP1_3 | MYLK_1 | 1 |
| MMP2_2 | 0.5962 | 0.5897 | 2 |
| MSH2_3 | CENPF_1 | BRAF_5 | 1 |
| MSH2_3 | 0.2893 | 0.2867 | 2 |
| MSH3_2 | CTGF_1 | MGAT5_1 | 1 |
| MSH3_2 | 0.2563 | 0.2538 | 2 |
| NR4A1_1 | PDGFA_3 | TIMP3_3 | 1 |
| NR4A1_1 | 0.2626 | 0.2506 | 2 |
| NRP1_1 | SOD2_1 | TP_3 | 1 |
| NRP1_1 | 0.5163 | 0.5083 | 2 |
| PDGFA_3 | TAGLN_3 | RHOB_1 | 1 |
| PDGFA_3 | 0.3152 | 0.3139 | 2 |
| PDGFC_3 | SFRP2_1 | IGFBP5_1 | 1 |
| PDGFC_3 | 0.6006 | 0.6005 | 2 |
| PDGFD_2 | AKT3_2 | BGN_1 | 1 |
| PDGFD_2 | 0.357 | 0.3536 | 2 |
| PDGFRA_2 | GJA1_1 | SFRP4_1 | 1 |
| PDGFRA_2 | 0.4657 | 0.4582 | 2 |
| PFN2_1 | ODC1_3 | CKS2_2 | 1 |
| PFN2_1 | 0.2643 | −0.2632 | 2 |
| PKR2_1 | LAMA3_1 | VDAC2_1 | 1 |
| PKR2_1 | 0.4249 | 0.4196 | 2 |
| PRDX2_1 | TUFM_1 | TK1_2 | 1 |
| PRDX2_1 | 0.2956 | 0.2937 | 2 |
| RAB32_1 | CMYC_3 | TERC_2 | 1 |
| RAB32_1 | 0.3082 | 0.3064 | 2 |
| RAD54L_1 | RCC1_1 | CDC25C_1 | 1 |
| RAD54L_1 | 0.4006 | 0.394 | 2 |
| RANBP2_3 | REG4_1 | ITGAV_1 | 1 |
| RANBP2_3 | 0.3191 | 0.3188 | 2 |
| RCC1_1 | HNRPD_1 | KIF22_1 | 1 |
| RCC1_1 | 0.3768 | 0.3731 | 2 |
| RHOB_1 | PDGFC_3 | FAP_1 | 1 |
| RHOB_1 | 0.3394 | 0.3377 | 2 |
| ROCK2_1 | PDGFA_3 | MASPIN_2 | 1 |
| ROCK2_1 | 0.2957 | −0.2938 | 2 |
| RUNX1_2 | TAGLN_3 | TIMP3_3 | 1 |
| RUNX1_2 | 0.4742 | 0.4708 | 2 |
| S100P_1 | KLF5_1 | CYP3A4_2 | 1 |
| S100P_1 | 0.2473 | 0.2433 | 2 |
| SAT_1 | GADD45B_1 | CTSB_1 | 1 |

TABLE C-continued

| | | | |
|---|---|---|---|
| SAT_1 | 0.2523 | 0.2505 | 2 |
| SEMA4B_1 | VDAC2_1 | MUC2_1 | 1 |
| SEMA4B_1 | 0.3683 | 0.3645 | 2 |
| SIAT4A_2 | IGFBP7_1 | CD44S_1 | 1 |
| SIAT4A_2 | 0.3833 | 0.3826 | 2 |
| SKP2_1 | HDAC1_1 | CDC25C_1 | 1 |
| SKP2_1 | 0.3143 | 0.3053 | 2 |
| SOD1_1 | NME1_3 | MUC2_1 | 1 |
| SOD1_1 | 0.2203 | 0.2185 | 2 |
| SOS1_1 | WISP1_1 | VCP_1 | 1 |
| SOS1_1 | 0.2479 | −0.2473 | 2 |
| SPARC_1 | CTHRC1_1 | PDGFC_3 | 1 |
| SPARC_1 | 0.6964 | 0.6961 | 2 |
| SPRY1_1 | DPYD_2 | SGCB_1 | 1 |
| SPRY1_1 | 0.4046 | 0.4012 | 2 |
| SPRY2_2 | TLN1_1 | CRIPTO_TDGF1_OFFICIAL_1 | 1 |
| SPRY2_2 | 0.2825 | 0.2821 | 2 |
| STK15_2 | C20ORF126_1 | TIMP3_3 | 1 |
| STK15_2 | 0.3739 | −0.3732 | 2 |
| TCF_1_1 | CXCR4_3 | VEGFB_1 | 1 |
| TCF_1_1 | −0.3387 | 0.338 | 2 |
| THBS1_1 | IGFBP5_1 | CTHRC1_1 | 1 |
| THBS1_1 | 0.6177 | 0.5994 | 2 |
| TIMP1_3 | MCP1_1 | COL1A1_1 | 1 |
| TIMP1_3 | 0.5922 | 0.5731 | 2 |
| TOP2A_4 | CCNB1_2 | HSPE1_1 | 1 |
| TOP2A_4 | 0.3692 | 0.3686 | 2 |
| TP53BP1_2 | PDGFRA_2 | FZD1_1 | 1 |
| TP53BP1_2 | 0.2892 | 0.2882 | 2 |
| UBE2C_1 | CDC25C_1 | MAD2L1_1 | 1 |
| UBE2C_1 | 0.3254 | 0.3219 | 2 |
| UPP1_1 | ANXA2_2 | LAMA3_1 | 1 |
| UPP1_1 | 0.3042 | 0.299 | 2 |
| VCP_1 | CLDN7_2 | BUB1_1 | 1 |
| VCP_1 | 0.3854 | 0.3796 | 2 |
| VDAC2_1 | PLK_3 | ITGB1_1 | 1 |
| VDAC2_1 | 0.3017 | 0.2988 | 2 |

SEQUENCE LISTING (3028 sequences)

SEQ ID NO: 1 - DNA, 23 bp, Artificial Sequence
  Synthetic Oligonucleotide
cgttccgatcctctatactgcat

SEQ ID NO: 2 - DNA, 25 bp, Artificial Sequence
  Synthetic Oligonucleotide
atgcctacagcaccctgatgtcgca

SEQ ID NO: 3 - DNA, 22 bp, Artificial Sequence
  Synthetic Oligonucleotide
aggtccctgttggccttatagg

SEQ ID NO: 4 - DNA, 20 bp, Artificial Sequence
  Synthetic Oligonucleotide
aaacaccactggagcattga

SEQ ID NO: 5 - DNA, 24 bp, Artificial Sequence
  Synthetic Oligonucleotide
ctcgccaatgatgctgctcaagtt

SEQ ID NO: 6 - DNA, 20 bp, Artificial Sequence
  Synthetic Oligonucleotide
caagcctggaacctatagcc

SEQ ID NO: 7 - DNA, 20 bp, Artificial Sequence
  Synthetic Oligonucleotide
tgcagactgtaccatgctga

SEQ ID NO: 8 - DNA, 22 bp, Artificial Sequence
  Synthetic Oligonucleotide
ctgcacacggttctaggctccg

SEQ ID NO: 9 - DNA, 20 bp, Artificial Sequence
  Synthetic Oligonucleotide
ggccagcaccataatcctat

SEQ ID NO: 10 - DNA, 18 bp, Artificial Sequence
  Synthetic Oligonucleotide
ggatgaacctcgacctgc

SEQ ID NO: 11 - DNA, 24 bp, Artificial Sequence
  Synthetic Oligonucleotide
ccagatagcctcgtccgagtgctc

SEQ ID NO: 12 - DNA, 18 bp, Artificial Sequence
  Synthetic Oligonucleotide
gagctgcaccgtctccag

SEQ ID NO: 13 - DNA, 19 bp, Artificial Sequence
  Synthetic Oligonucleotide
gctaccaagtccgtgctgt

SEQ ID NO: 14 - DNA, 28 bp, Artificial Sequence
  Synthetic Oligonucleotide
tgatcgacaaatgttacccagacacaca

SEQ ID NO: 15 - DNA, 20 bp, Artificial Sequence
  Synthetic Oligonucleotide
gaaaactgcttctgcaatgg

SEQ ID NO: 16 - DNA, 20 bp, Artificial Sequence
  Synthetic Oligonucleotide
cccatcaacttgtgccagta

SEQ ID NO: 17 - DNA, 24 bp, Artificial Sequence
  Synthetic Oligonucleotide
tgcctactccactgcacagaccct

SEQ ID NO: 18 - DNA, 19 bp, Artificial Sequence
  Synthetic Oligonucleotide
ggtgatggttcgaccactg

SEQ ID NO: 19 - DNA, 20 bp, Artificial Sequence
  Synthetic Oligonucleotide
gaagtgccaggaggcgatta

SEQ ID NO: 20 - DNA, 28 bp, Artificial Sequence
  Synthetic Oligonucleotide
tgctacttgcaaaggcgtgtcctactgc

SEQ ID NO: 21 - DNA, 21 bp, Artificial Sequence
  Synthetic Oligonucleotide
cgggcactcactgctattacc

SEQ ID NO: 22 - DNA, 19 bp, Artificial Sequence
  Synthetic Oligonucleotide
ggagaagggtggagtgcag

SEQ ID NO: 23 - DNA, 24 bp, Artificial Sequence
  Synthetic Oligonucleotide
cgcacagtcagaatccatctgggt

SEQ ID NO: 24 - DNA, 20 bp, Artificial Sequence
  Synthetic Oligonucleotide
cagggtcaggtctctggatg

SEQ ID NO: 25 - DNA, 20 bp, Artificial Sequence
  Synthetic Oligonucleotide
ttgacaacctgctggacatc

SEQ ID NO: 26 - DNA, 24 bp, Artificial Sequence
  Synthetic Oligonucleotide
ccctgagcagactgtaggccacct

SEQ ID NO: 27 - DNA, 20 bp, Artificial Sequence
  Synthetic Oligonucleotide
atgggatccttgctgctatc

SEQ ID NO: 28 - DNA, 18 bp, Artificial Sequence
  Synthetic Oligonucleotide
cttttccctccagtggca

SEQ ID NO: 29 - DNA, 24 bp, Artificial Sequence
  Synthetic Oligonucleotide
ctcctggaaacagtccacttgggc

SEQ ID NO: 30 - DNA, 20 bp, Artificial Sequence
  Synthetic Oligonucleotide
atttggaaggcactgggttt

SEQ ID NO: 31 - DNA, 20 bp, Artificial Sequence
  Synthetic Oligonucleotide
tagagagcccctgacaatcc

SEQ ID NO: 32 - DNA, 25 bp, Artificial Sequence
  Synthetic Oligonucleotide
tggctctagctcctgatgaagcctc

SEQ ID NO: 33 - DNA, 20 bp, Artificial Sequence
  Synthetic Oligonucleotide
ggttggtcttggaaagagga

SEQ ID NO: 34 - DNA, 20 bp, Artificial Sequence
  Synthetic Oligonucleotide
cgcttctatggcgctgagat

SEQ ID NO: 35 - DNA, 24 bp, Artificial Sequence
  Synthetic Oligonucleotide
cagccctggactacctgcactcgg

SEQ ID NO: 36 - DNA, 20 bp, Artificial Sequence
  Synthetic Oligonucleotide
tcccggtacaccacgttctt

SEQ ID NO: 37 - DNA, 19 bp, Artificial Sequence
  Synthetic Oligonucleotide
tcctgccacccttcaaacc

SEQ ID NO: 38 - DNA, 24 bp, Artificial Sequence
  Synthetic Oligonucleotide
caggtcacgtccgaggtcgacaca

SEQ ID NO: 39 - DNA, 21 bp, Artificial Sequence
  Synthetic Oligonucleotide
ggcggtaaattcatcatcgaa

SEQ ID NO: 40 - DNA, 25 bp, Artificial Sequence
  Synthetic Oligonucleotide
ttgtctctgccttggactatctaca

SEQ ID NO: 41 - DNA, 23 bp, Artificial Sequence
  Synthetic Oligonucleotide
tcacggtacacaatctttccgga

SEQ ID NO: 42 - DNA, 24 bp, Artificial Sequence
  Synthetic Oligonucleotide
ccagcattagattctccaacttga

SEQ ID NO: 43 - DNA, 21 bp, Artificial Sequence
  Synthetic Oligonucleotide
caagaagaggctctaccctgg

SEQ ID NO: 44 - DNA, 24 bp, Artificial Sequence
  Synthetic Oligonucleotide
actgggaatttccaaggccacctt

SEQ ID NO: 45 - DNA, 20 bp, Artificial Sequence
  Synthetic Oligonucleotide
aaatgagctctgcgatcctc

SEQ ID NO: 46 - DNA, 21 bp, Artificial Sequence
  Synthetic Oligonucleotide
gaggaatatggaatccaaggg

SEQ ID NO: 47 - DNA, 24 bp, Artificial Sequence
  Synthetic Oligonucleotide
ccagttcctgccgtctgctcttct

SEQ ID NO: 48 - DNA, 18 bp, Artificial Sequence
  Synthetic Oligonucleotide
gtggcggagatcaagagg

SEQ ID NO: 49 - DNA, 25 bp, Artificial Sequence
  Synthetic Oligonucleotide
gaaggagataaggaggatgttgaca

SEQ ID NO: 50 - DNA, 26 bp, Artificial Sequence
  Synthetic Oligonucleotide
agtgaaggccgcaagacaggcttttc

SEQ ID NO: 51 - DNA, 18 bp, Artificial Sequence
  Synthetic Oligonucleotide
cgccacggagatccaatc

SEQ ID NO: 52 - DNA, 18 bp, Artificial Sequence
  Synthetic Oligonucleotide
gcctgtacgtgccagctc

SEQ ID NO: 53 - DNA, 24 bp, Artificial Sequence
  Synthetic Oligonucleotide
tgccagagcctcaactgtctctgc

SEQ ID NO: 54 - DNA, 19 bp, Artificial Sequence
  Synthetic Oligonucleotide
tcatcggagcttgatctcg

SEQ ID NO: 55 - DNA, 21 bp, Artificial Sequence
  Synthetic Oligonucleotide
gatggttcagctctgcaagga

SEQ ID NO: 56 - DNA, 30 bp, Artificial Sequence
  Synthetic Oligonucleotide
cgatttgaatatctttccttctcgcccacc

SEQ ID NO: 57 - DNA, 18 bp, Artificial Sequence
  Synthetic Oligonucleotide
tcgaccgtggctgctcat

SEQ ID NO: 58 - DNA, 20 bp, Artificial Sequence
  Synthetic Oligonucleotide
ccgtgaaagctgctctgtaa

SEQ ID NO: 59 - DNA, 24 bp, Artificial Sequence
  Synthetic Oligonucleotide
aagctgacacagccctcccaagtg

SEQ ID NO: 60 - DNA, 20 bp, Artificial Sequence
  Synthetic Oligonucleotide
ttgcagtgggaagaacagtc

SEQ ID NO: 61 - DNA, 20 bp, Artificial Sequence
  Synthetic Oligonucleotide
ctccaggtgtacctccaacc

SEQ ID NO: 62 - DNA, 24 bp, Artificial Sequence
  Synthetic Oligonucleotide
agccttctcccacagctgcctaca

SEQ ID NO: 63 - DNA, 20 bp, Artificial Sequence
  Synthetic Oligonucleotide
gagaaggctgggagactctg

SEQ ID NO: 64 - DNA, 22 bp, Artificial Sequence
  Synthetic Oligonucleotide
gcccctatcctaccttcaatcc

SEQ ID NO: 65 - DNA, 19 bp, Artificial Sequence
  Synthetic Oligonucleotide
tcctcggatgtcgctgcct

SEQ ID NO: 66 - DNA, 24 bp, Artificial Sequence
  Synthetic Oligonucleotide
cctttaaccattatggccttatgc

SEQ ID NO: 67 - DNA, 23 bp, Artificial Sequence
  Synthetic Oligonucleotide
caagacactaagggcgactacca

SEQ ID NO: 68 - DNA, 24 bp, Artificial Sequence
  Synthetic Oligonucleotide
ccaccacacaggtacagcagcgct

SEQ ID NO: 69 - DNA, 19 bp, Artificial Sequence
  Synthetic Oligonucleotide
cgtgtcgggcttcagtcat

SEQ ID NO: 70 - DNA, 20 bp, Artificial Sequence
  Synthetic Oligonucleotide
gctcaagcctggaagatgac

SEQ ID NO: 71 - DNA, 24 bp, Artificial Sequence
  Synthetic Oligonucleotide
agtaccctgaagtgtcccccacca

SEQ ID NO: 72 - DNA, 19 bp, Artificial Sequence
  Synthetic Oligonucleotide
agaaccaccaacatccgct

SEQ ID NO: 73 - DNA, 20 bp, Artificial Sequence
  Synthetic Oligonucleotide
gactgcaaagatggaaacga

SEQ ID NO: 74 - DNA, 24 bp, Artificial Sequence
  Synthetic Oligonucleotide
ctatgacgatgccctcaacgcctc

SEQ ID NO: 75 - DNA, 20 bp, Artificial Sequence
  Synthetic Oligonucleotide
tagccataaggtccgctctc

SEQ ID NO: 76 - DNA, 20 bp, Artificial Sequence
  Synthetic Oligonucleotide
ggacagcaggaatgtgtttc

SEQ ID NO: 77 - DNA, 22 bp, Artificial Sequence
  Synthetic Oligonucleotide
cattggctccccgtgacctgta

SEQ ID NO: 78 - DNA, 20 bp, Artificial Sequence
  Synthetic Oligonucleotide
acccactcgatttgtttctg

SEQ ID NO: 79 - DNA, 20 bp, Artificial Sequence
  Synthetic Oligonucleotide
gatgaagcctttcgcaagtt

SEQ ID NO: 80 - DNA, 21 bp, Artificial Sequence
  Synthetic Oligonucleotide
ctttcgggaagccaggccctt

SEQ ID NO: 81 - DNA, 20 bp, Artificial Sequence
  Synthetic Oligonucleotide
aggtctccacacagcacaag

SEQ ID NO: 82 - DNA, 19 bp, Artificial Sequence
  Synthetic Oligonucleotide
accccggcctgtatatcat

SEQ ID NO: 83 - DNA, 24 bp, Artificial Sequence
  Synthetic Oligonucleotide
ccaatggctcgagttcttgatccc

SEQ ID NO: 84 - DNA, 21 bp, Artificial Sequence
  Synthetic Oligonucleotide
ctatctggctctttgctgcat

SEQ ID NO: 85 - DNA, 22 bp, Artificial Sequence
  Synthetic Oligonucleotide
ccaccttggaccaaagtaaagc

SEQ ID NO: 86 - DNA, 22 bp, Artificial Sequence
  Synthetic Oligonucleotide
ctccccaacacgctgaaacccg

SEQ ID NO: 87 - DNA, 21 bp, Artificial Sequence
  Synthetic Oligonucleotide
tctcagcgtcacctggtagga

SEQ ID NO: 88 - DNA, 21 bp, Artificial Sequence
  Synthetic Oligonucleotide
ggaaacacactggaggacaag

SEQ ID NO: 89 - DNA, 24 bp, Artificial Sequence
  Synthetic Oligonucleotide
tcatcagccgcatcaaacagagtg

SEQ ID NO: 90 - DNA, 19 bp, Artificial Sequence
  Synthetic Oligonucleotide
cgcatcttggcagaaagtt

SEQ ID NO: 91 - DNA, 27 bp, Artificial Sequence
  Synthetic Oligonucleotide
tgtgagtgaaatgccttctagtagtga

SEQ ID NO: 92 - DNA, 23 bp, Artificial Sequence
  Synthetic Oligonucleotide
ccgtcctcgggagccgactatga

SEQ ID NO: 93 - DNA, 27 bp, Artificial Sequence
  Synthetic Oligonucleotide
ttgtggttcgttatcatactcttctga

SEQ ID NO: 94 - DNA, 21 bp, Artificial Sequence
  Synthetic Oligonucleotide
cgcagtgcagctgagtatctg

SEQ ID NO: 95 - DNA, 23 bp, Artificial Sequence
  Synthetic Oligonucleotide
tcgcaccaggaagctgccattga

SEQ ID NO: 96 - DNA, 21 bp, Artificial Sequence
  Synthetic Oligonucleotide
tgcccagggctactctcactt

SEQ ID NO: 97 - DNA, 20 bp, Artificial Sequence
  Synthetic Oligonucleotide
actggcccacttagtcctca

SEQ ID NO: 98 - DNA, 23 bp, Artificial Sequence
  Synthetic Oligonucleotide
ctcccaacctgctgtccctcaag

SEQ ID NO: 99 - DNA, 20 bp, Artificial Sequence
  Synthetic Oligonucleotide
ctgaactccacaggctggta

SEQ ID NO: 100 - DNA, 18 bp, Artificial Sequence
  Synthetic Oligonucleotide
gcagccacctgcaacttt

SEQ ID NO: 101 - DNA, 24 bp, Artificial Sequence
  Synthetic Oligonucleotide
caggcgagagagcatcccgtctac

SEQ ID NO: 102 - DNA, 18 bp, Artificial Sequence
  Synthetic Oligonucleotide
tccaggagggacagctca

SEQ ID NO: 103 - DNA, 20 bp, Artificial Sequence
  Synthetic Oligonucleotide
gatgctgccactcaacaact

SEQ ID NO: 104 - DNA, 24 bp, Artificial Sequence
  Synthetic Oligonucleotide
agttagacgcacgccacgactcaa

SEQ ID NO: 105 - DNA, 20 bp, Artificial Sequence
  Synthetic Oligonucleotide
tgtccttgcttcagcaactc

SEQ ID NO: 106 - DNA, 18 bp, Artificial Sequence
  Synthetic Oligonucleotide
ccgctttcgctacagcat

SEQ ID NO: 107 - DNA, 24 bp, Artificial Sequence
  Synthetic Oligonucleotide
tccagcctgtctccagtaggccac

SEQ ID NO: 108 - DNA, 21 bp, Artificial Sequence
  Synthetic Oligonucleotide
tgggagtatcggatgtagctg

SEQ ID NO: 109 - DNA, 21 bp, Artificial Sequence
  Synthetic Oligonucleotide
agctgcagaagagctgcacat

SEQ ID NO: 110 - DNA, 22 bp, Artificial Sequence
  Synthetic Oligonucleotide
tgacgagcagcgaacagccacg

SEQ ID NO: 111 - DNA, 20 bp, Artificial Sequence
  Synthetic Oligonucleotide
gcatctgccaactcctccat

SEQ ID NO: 112 - DNA, 20 bp, Artificial Sequence
  Synthetic Oligonucleotide
ggctatgtctttgcaccagc

SEQ ID NO: 113 - DNA, 24 bp, Artificial Sequence
  Synthetic Oligonucleotide
accagcgccaacgacagtgagata

SEQ ID NO: 114 - DNA, 18 bp, Artificial Sequence
  Synthetic Oligonucleotide
atccgtcagcgcatcact

SEQ ID NO: 115 - DNA, 18 bp, Artificial Sequence
  Synthetic Oligonucleotide
ccgtgtgacagcatcgtt

SEQ ID NO: 116 - DNA, 24 bp, Artificial Sequence
  Synthetic Oligonucleotide
cgtactacttctgcggggaaccca

SEQ ID NO: 117 - DNA, 18 bp, Artificial Sequence
  Synthetic Oligonucleotide
ctcaccagggtgcggtag

SEQ ID NO: 118 - DNA, 22 bp, Artificial Sequence
  Synthetic Oligonucleotide
ggctcttgtgcgtactgtcctt

SEQ ID NO: 119 - DNA, 29 bp, Artificial Sequence
  Synthetic Oligonucleotide
aggctcagtgatgtcttccctgtcaccag

SEQ ID NO: 120 - DNA, 23 bp, Artificial Sequence
  Synthetic Oligonucleotide
tcagatgacgaagagcacagatg

SEQ ID NO: 121 - DNA, 19 bp, Artificial Sequence
  Synthetic Oligonucleotide
gggtcaggtgcctcgagat

SEQ ID NO: 122 - DNA, 24 bp, Artificial Sequence
  Synthetic Oligonucleotide
tgggcccagagcatgttccagatc

SEQ ID NO: 123 - DNA, 21 bp, Artificial Sequence
  Synthetic Oligonucleotide
ctgctcactcggctcaaactc

SEQ ID NO: 124 - DNA, 23 bp, Artificial Sequence
  Synthetic Oligonucleotide
cgttgtcagcacttggaatacaa

SEQ ID NO: 125 - DNA, 26 bp, Artificial Sequence
  Synthetic Oligonucleotide
cccaattaacatgacccggcaaccat

SEQ ID NO: 126 - DNA, 24 bp, Artificial Sequence
  Synthetic Oligonucleotide
gttcaacctcttcctgtggactgt

SEQ ID NO: 127 - DNA, 19 bp, Artificial Sequence
  Synthetic Oligonucleotide
ctaggggcaaaaagcatga

SEQ ID NO: 128 - DNA, 24 bp, Artificial Sequence
  Synthetic Oligonucleotide
ttccatgccagacaggaaaaagca

SEQ ID NO: 129 - DNA, 20 bp, Artificial Sequence
  Synthetic Oligonucleotide
ctaaatgcccaaggtgactg

SEQ ID NO: 130 - DNA, 21 bp, Artificial Sequence
  Synthetic Oligonucleotide
gaaagtaagccaggcccagtt

SEQ ID NO: 131 - DNA, 27 bp, Artificial Sequence
  Synthetic Oligonucleotide
cagaactccctcctggacacatcccaa

SEQ ID NO: 132 - DNA, 21 bp, Artificial Sequence
  Synthetic Oligonucleotide
acctctttgcggatcacttga

SEQ ID NO: 133 - DNA, 20 bp, Artificial Sequence
  Synthetic Oligonucleotide
ccattcccaccattctacct

SEQ ID NO: 134 - DNA, 21 bp, Artificial Sequence
  Synthetic Oligonucleotide
acaccccagacgtcctggcct

SEQ ID NO: 135 - DNA, 20 bp, Artificial Sequence
  Synthetic Oligonucleotide
gggaacatagacccaccaat

SEQ ID NO: 136 - DNA, 18 bp, Artificial Sequence
  Synthetic Oligonucleotide
ccgccgtggacacagact

SEQ ID NO: 137 - DNA, 25 bp, Artificial Sequence
  Synthetic Oligonucleotide
tgccactcggaaaaagacctctcgg

SEQ ID NO: 138 - DNA, 21 bp, Artificial Sequence
  Synthetic Oligonucleotide
ttgccgtcagaaaacatgtca

SEQ ID NO: 139 - DNA, 20 bp, Artificial Sequence
  Synthetic Oligonucleotide
cctggagggtcctgtacaat

SEQ ID NO: 140 - DNA, 24 bp, Artificial Sequence
  Synthetic Oligonucleotide
catcatgggactcctgcccttacc

SEQ ID NO: 141 - DNA, 19 bp, Artificial Sequence
  Synthetic Oligonucleotide
ctaattgggctccatctcg

SEQ ID NO: 142 - DNA, 20 bp, Artificial Sequence
  Synthetic Oligonucleotide
ccccgagacaacggagataa

SEQ ID NO: 143 - DNA, 23 bp, Artificial Sequence
  Synthetic Oligonucleotide
ctttccgttggcatccgcaacag

SEQ ID NO: 144 - DNA, 19 bp, Artificial Sequence
  Synthetic Oligonucleotide
ctcgggtttggcctctttc

SEQ ID NO: 145 - DNA, 25 bp, Artificial Sequence
  Synthetic Oligonucleotide
cagatggacctagtacccactgaga

SEQ ID NO: 146 - DNA, 22 bp, Artificial Sequence
  Synthetic Oligonucleotide
ttccacgccgaaggacagcgat

SEQ ID NO: 147 - DNA, 24 bp, Artificial Sequence
  Synthetic Oligonucleotide
cctatgatttaagggcatttttcc

SEQ ID NO: 148 - DNA, 19 bp, Artificial Sequence
  Synthetic Oligonucleotide
gctgggatggcttttgtca

SEQ ID NO: 149 - DNA, 25 bp, Artificial Sequence
  Synthetic Oligonucleotide
tcttcaggaccccctttccactggc

SEQ ID NO: 150 - DNA, 21 bp, Artificial Sequence
  Synthetic Oligonucleotide
gcctggaccagctgttttctc

SEQ ID NO: 151 - DNA, 20 bp, Artificial Sequence
  Synthetic Oligonucleotide
aattaccaagcagccgaaga

SEQ ID NO: 152 - DNA, 28 bp, Artificial Sequence
  Synthetic Oligonucleotide
ccacccacgaatggttatcttacgactg

SEQ ID NO: 153 - DNA, 20 bp, Artificial Sequence
  Synthetic Oligonucleotide
caggcggacaatgtaacgta

SEQ ID NO: 154 - DNA, 18 bp, Artificial Sequence
  Synthetic Oligonucleotide
aacccacccctgtcttgg

SEQ ID NO: 155 - DNA, 24 bp, Artificial Sequence
  Synthetic Oligonucleotide
tccgggtagctctcaaactcgagg

SEQ ID NO: 156 - DNA, 18 bp, Artificial Sequence
  Synthetic Oligonucleotide
ctcagctgacgggaaagg

SEQ ID NO: 157 - DNA, 24 bp, Artificial Sequence
  Synthetic Oligonucleotide
cttttgtggaactctatgggaaca

SEQ ID NO: 158 - DNA, 20 bp, Artificial Sequence
  Synthetic Oligonucleotide
ttcggctctcggctgctgca

SEQ ID NO: 159 - DNA, 19 bp, Artificial Sequence
  Synthetic Oligonucleotide
cagcggttgaagcgttcct

SEQ ID NO: 160 - DNA, 26 bp, Artificial Sequence
  Synthetic Oligonucleotide
tgtactggcgaagaatatttggtaaa

SEQ ID NO: 161 - DNA, 24 bp, Artificial Sequence
  Synthetic Oligonucleotide
cagggcatcgatctctcaccctgg

SEQ ID NO: 162 - DNA, 20 bp, Artificial Sequence
  Synthetic Oligonucleotide
gccacgtgattcttccacaa

SEQ ID NO: 163 - DNA, 24 bp, Artificial Sequence
  Synthetic Oligonucleotide
ccaggaagaatgcttaagatgtga

SEQ ID NO: 164 - DNA, 26 bp, Artificial Sequence
  Synthetic Oligonucleotide
ttcgccaggtcattgagatccatcca

SEQ ID NO: 165 - DNA, 24 bp, Artificial Sequence
  Synthetic Oligonucleotide
tggtgatgggagttgtattttcag

SEQ ID NO: 166 - DNA, 18 bp, Artificial Sequence
  Synthetic Oligonucleotide
gagctccgcaaggatgac

SEQ ID NO: 167 - DNA, 24 bp, Artificial Sequence
  Synthetic Oligonucleotide
caagggtctccagcacctctacgc

SEQ ID NO: 168 - DNA, 20 bp, Artificial Sequence
  Synthetic Oligonucleotide
cttgttgttcaccaggacga

SEQ ID NO: 169 - DNA, 20 bp, Artificial Sequence
  Synthetic Oligonucleotide
ggactgtgaggtcaacaacg

SEQ ID NO: 170 - DNA, 24 bp, Artificial Sequence
  Synthetic Oligonucleotide
tgtgatgcactcatccctgaggct

SEQ ID NO: 171 - DNA, 20 bp, Artificial Sequence
  Synthetic Oligonucleotide
ggaagccaaacaccagtagg

SEQ ID NO: 172 - DNA, 23 bp, Artificial Sequence
  Synthetic Oligonucleotide
attcctatggctctgcaattgtc

SEQ ID NO: 173 - DNA, 23 bp, Artificial Sequence
  Synthetic Oligonucleotide
ccggttaactgtggcctgtgccc

SEQ ID NO: 174 - DNA, 21 bp, Artificial Sequence
  Synthetic Oligonucleotide
ggcaggagtgaatggctcttc

SEQ ID NO: 175 - DNA, 20 bp, Artificial Sequence
  Synthetic Oligonucleotide
cctgcaaaagggaacaagag

SEQ ID NO: 176 - DNA, 21 bp, Artificial Sequence
  Synthetic Oligonucleotide
cttcgcctccagatggctccc

SEQ ID NO: 177 - DNA, 20 bp, Artificial Sequence
  Synthetic Oligonucleotide
cgtggttgactctgatctcg

SEQ ID NO: 178 - DNA, 20 bp, Artificial Sequence
  Synthetic Oligonucleotide
ggttgctgcctccatcaaag

SEQ ID NO: 179 - DNA, 27 bp, Artificial Sequence
  Synthetic Oligonucleotide
acatcacagccaaaccacacagcctct

SEQ ID NO: 180 - DNA, 24 bp, Artificial Sequence
  Synthetic Oligonucleotide
ccagcttgctattgaagtgttttc

SEQ ID NO: 181 - DNA, 20 bp, Artificial Sequence
  Synthetic Oligonucleotide
atgtggacgctctttcaatg

SEQ ID NO: 182 - DNA, 24 bp, Artificial Sequence
  Synthetic Oligonucleotide
accgcagtccgtctaagaagcacg

SEQ ID NO: 183 - DNA, 20 bp, Artificial Sequence
  Synthetic Oligonucleotide
accatggtcgacctttagga

SEQ ID NO: 184 - DNA, 18 bp, Artificial Sequence
  Synthetic Oligonucleotide
gggctagccattgaggtg

SEQ ID NO: 185 - DNA, 24 bp, Artificial Sequence
  Synthetic Oligonucleotide
ctcacctccatcagactcggaccc

SEQ ID NO: 186 - DNA, 20 bp, Artificial Sequence
  Synthetic Oligonucleotide
gctaatcctgacatgctggc

SEQ ID NO: 187 - DNA, 22 bp, Artificial Sequence
  Synthetic Oligonucleotide
tcgtggaacatgacaaggaatt

SEQ ID NO: 188 - DNA, 23 bp, Artificial Sequence
  Synthetic Oligonucleotide
ttccacccacgctaccaccatcg

SEQ ID NO: 189 - DNA, 22 bp, Artificial Sequence
  Synthetic Oligonucleotide
tggaaagatcaaaccggaactc

SEQ ID NO: 190 - DNA, 20 bp, Artificial Sequence
  Synthetic Oligonucleotide
ttggttcagcgaactattgc

SEQ ID NO: 191 - DNA, 24 bp, Artificial Sequence
  Synthetic Oligonucleotide
caaacagattcagatggtccggca

SEQ ID NO: 192 - DNA, 20 bp, Artificial Sequence
  Synthetic Oligonucleotide
tctccatatcggcctttacc

SEQ ID NO: 193 - DNA, 20 bp, Artificial Sequence
  Synthetic Oligonucleotide
ccttccgaccagcagatgaa

SEQ ID NO: 194 - DNA, 25 bp, Artificial Sequence
  Synthetic Oligonucleotide
caatttgggcaacgagaccgatcct

SEQ ID NO: 195 - DNA, 24 bp, Artificial Sequence
  Synthetic Oligonucleotide
tttatatgcacattgggagctgat

SEQ ID NO: 196 - DNA, 20 bp, Artificial Sequence
  Synthetic Oligonucleotide
tcagggggctagaaatctgt

SEQ ID NO: 197 - DNA, 23 bp, Artificial Sequence
  Synthetic Oligonucleotide
ctatgggcccttcaccaacatgc

SEQ ID NO: 198 - DNA, 20 bp, Artificial Sequence
  Synthetic Oligonucleotide
ccattccagttgatctgtgg

SEQ ID NO: 199 - DNA, 20 bp, Artificial Sequence
  Synthetic Oligonucleotide
agttcgtgctttgcaagatg

SEQ ID NO: 200 - DNA, 29 bp, Artificial Sequence
  Synthetic Oligonucleotide
cattcttcactgcttcataaagctctgca

SEQ ID NO: 201 - DNA, 20 bp, Artificial Sequence
  Synthetic Oligonucleotide
aaggtaagctgggtctgctg

SEQ ID NO: 202 - DNA, 20 bp, Artificial Sequence
  Synthetic Oligonucleotide
gtgcaggaaaggttcacaaa

SEQ ID NO: 203 - DNA, 24 bp, Artificial Sequence
  Synthetic Oligonucleotide
agtgtctgcgtccaatacacgcgt

SEQ ID NO: 204 - DNA, 20 bp, Artificial Sequence
  Synthetic Oligonucleotide
gcacacacgatggagtaagg

SEQ ID NO: 205 - DNA, 27 bp, Artificial Sequence
  Synthetic Oligonucleotide
cagtgatccactttaacaaccctaaag

SEQ ID NO: 206 - DNA, 24 bp, Artificial Sequence
  Synthetic Oligonucleotide
tcaggcatctctggcagcgaacac

SEQ ID NO: 207 - DNA, 21 bp, Artificial Sequence
  Synthetic Oligonucleotide
agcatggcctgtaatggtgaa

SEQ ID NO: 208 - DNA, 20 bp, Artificial Sequence
  Synthetic Oligonucleotide
gttgggacacagttggtctg

SEQ ID NO: 209 - DNA, 23 bp, Artificial Sequence
  Synthetic Oligonucleotide
cagtcggcccaggacggtctact

SEQ ID NO: 210 - DNA, 20 bp, Artificial Sequence
  Synthetic Oligonucleotide
tgaagcagtcagttgtgctg

SEQ ID NO: 211 - DNA, 21 bp, Artificial Sequence
  Synthetic Oligonucleotide
ccgaggttaatccagcacgta

SEQ ID NO: 212 - DNA, 23 bp, Artificial Sequence
  Synthetic Oligonucleotide
tgctgggagcctacacttggccc

SEQ ID NO: 213 - DNA, 21 bp, Artificial Sequence
  Synthetic Oligonucleotide
aagacatggcgctctcagttc

SEQ ID NO: 214 - DNA, 24 bp, Artificial Sequence
  Synthetic Oligonucleotide
tcaacagaaggctgaaccactaga

SEQ ID NO: 215 - DNA, 24 bp, Artificial Sequence
  Synthetic Oligonucleotide
tacagtcccagcaccgacaattcc

SEQ ID NO: 216 - DNA, 22 bp, Artificial Sequence
  Synthetic Oligonucleotide
caacagagtttgccgagacact

SEQ ID NO: 217 - DNA, 22 bp, Artificial Sequence
  Synthetic Oligonucleotide
ctgaagcagatggttcatcatt

SEQ ID NO: 218 - DNA, 24 bp, Artificial Sequence
  Synthetic Oligonucleotide
cctcgctttgtttaacagcccagg

SEQ ID NO: 219 - DNA, 22 bp, Artificial Sequence
  Synthetic Oligonucleotide
gctgattcccaagagtctaacc

SEQ ID NO: 220 - DNA, 20 bp, Artificial Sequence
  Synthetic Oligonucleotide
ccatctcgctgagatacgaa

SEQ ID NO: 221 - DNA, 28 bp, Artificial Sequence
  Synthetic Oligonucleotide
gggagggtgtaccattacaggatcaaca

SEQ ID NO: 222 - DNA, 20 bp, Artificial Sequence
  Synthetic Oligonucleotide
agacgtagagcttgccatca

SEQ ID NO: 223 - DNA, 25 bp, Artificial Sequence
  Synthetic Oligonucleotide
gaggcaactgcttatggcttaatta

SEQ ID NO: 224 - DNA, 24 bp, Artificial Sequence
  Synthetic Oligonucleotide
ttacagcgacagtcatggccgcat

SEQ ID NO: 225 - DNA, 18 bp, Artificial Sequence
  Synthetic Oligonucleotide
ggcactcggcttgagcat

SEQ ID NO: 226 - DNA, 24 bp, Artificial Sequence
  Synthetic Oligonucleotide
aactcagacttggaaatgccttct

SEQ ID NO: 227 - DNA, 26 bp, Artificial Sequence
  Synthetic Oligonucleotide
aacttccacccccctcattggtcaca

SEQ ID NO: 228 - DNA, 27 bp, Artificial Sequence
  Synthetic Oligonucleotide
ctggtctctatgaaatggtgttgtaac

SEQ ID NO: 229 - DNA, 23 bp, Artificial Sequence
  Synthetic Oligonucleotide
tgaggagtggtattttggcaaga

SEQ ID NO: 230 - DNA, 24 bp, Artificial Sequence
  Synthetic Oligonucleotide
aaccgctctgactcccgtctggtg

SEQ ID NO: 231 - DNA, 21 bp, Artificial Sequence
  Synthetic Oligonucleotide
ctctcgggttctctgcattga

SEQ ID NO: 232 - DNA, 20 bp, Artificial Sequence
  Synthetic Oligonucleotide
tcagctgtgagctgcggata

SEQ ID NO: 233 - DNA, 19 bp, Artificial Sequence
  Synthetic Oligonucleotide
caggtcccattgccgggcg

SEQ ID NO: 234 - DNA, 24 bp, Artificial Sequence
  Synthetic Oligonucleotide
acggtcctaggtttgaggttaaga

SEQ ID NO: 235 - DNA, 20 bp, Artificial Sequence
  Synthetic Oligonucleotide
ccagcactgctcgttactgt

SEQ ID NO: 236 - DNA, 23 bp, Artificial Sequence
  Synthetic Oligonucleotide
tgggacctcagaccactgaaggc

SEQ ID NO: 237 - DNA, 21 bp, Artificial Sequence
  Synthetic Oligonucleotide
ttgacttcacggcagttcata

SEQ ID NO: 238 - DNA, 20 bp, Artificial Sequence
  Synthetic Oligonucleotide
ctacgagtcagcccatccat

SEQ ID NO: 239 - DNA, 24 bp, Artificial Sequence
  Synthetic Oligonucleotide
catggctaccacttcgacacagcc

SEQ ID NO: 240 - DNA, 18 bp, Artificial Sequence
  Synthetic Oligonucleotide
tgcccacggctttcttac

SEQ ID NO: 241 - DNA, 20 bp, Artificial Sequence
  Synthetic Oligonucleotide
atcctagccctggtttttgg

SEQ ID NO: 242 - DNA, 20 bp, Artificial Sequence
  Synthetic Oligonucleotide
tttgctgtcaccagcgtcgc

SEQ ID NO: 243 - DNA, 20 bp, Artificial Sequence
  Synthetic Oligonucleotide
ctgccttctcatctgcacaa

SEQ ID NO: 244 - DNA, 20 bp, Artificial Sequence
  Synthetic Oligonucleotide
gaaggccaagaaccgagtca

SEQ ID NO: 245 - DNA, 27 bp, Artificial Sequence
  Synthetic Oligonucleotide
ttatattccagtttaaggccaatcctc

SEQ ID NO: 246 - DNA, 24 bp, Artificial Sequence
  Synthetic Oligonucleotide
tccccagttagttcaaaagtcaca

SEQ ID NO: 247 - DNA, 26 bp, Artificial Sequence
  Synthetic Oligonucleotide
cactaaggtttgagacagttccagaa

SEQ ID NO: 248 - DNA, 26 bp, Artificial Sequence
  Synthetic Oligonucleotide
aacccaagctcaagacgcaggacgag

SEQ ID NO: 249 - DNA, 23 bp, Artificial Sequence
  Synthetic Oligonucleotide
gcgaattagccctctacaactga

SEQ ID NO: 250 - DNA, 20 bp, Artificial Sequence
  Synthetic Oligonucleotide
gattgtcactgatggggagg

SEQ ID NO: 251 - DNA, 24 bp, Artificial Sequence
  Synthetic Oligonucleotide
aggacctggatcatctcagcaggc

SEQ ID NO: 252 - DNA, 18 bp, Artificial Sequence
  Synthetic Oligonucleotide
ccttcagagcaggcttgg

SEQ ID NO: 253 - DNA, 23 bp, Artificial Sequence
  Synthetic Oligonucleotide
caagaagctgtacgagctcatca

SEQ ID NO: 254 - DNA, 22 bp, Artificial Sequence
  Synthetic Oligonucleotide
ccgctactcggagcccgacctg

SEQ ID NO: 255 - DNA, 22 bp, Artificial Sequence
  Synthetic Oligonucleotide
gcagcaaacgaaattgtcaaag

SEQ ID NO: 256 - DNA, 20 bp, Artificial Sequence
  Synthetic Oligonucleotide
cctcggggatactgtctgat

SEQ ID NO: 257 - DNA, 27 bp, Artificial Sequence
  Synthetic Oligonucleotide
caacaatcacaattttgcaaaagcacg

SEQ ID NO: 258 - DNA, 20 bp, Artificial Sequence
  Synthetic Oligonucleotide
gaagtttgggcactttctcc

SEQ ID NO: 259 - DNA, 18 bp, Artificial Sequence
  Synthetic Oligonucleotide
tgaatgccgtggattgca

SEQ ID NO: 260 - DNA, 25 bp, Artificial Sequence
  Synthetic Oligonucleotide
cactagccctggaccagccactgct

SEQ ID NO: 261 - DNA, 21 bp, Artificial Sequence
  Synthetic Oligonucleotide
acagggatcatgggacacaag

SEQ ID NO: 262 - DNA, 22 bp, Artificial Sequence
  Synthetic Oligonucleotide
atccattcgatctcaccaaggt

SEQ ID NO: 263 - DNA, 28 bp, Artificial Sequence
  Synthetic Oligonucleotide
tggcctcacaaggactaccctctcatcc

SEQ ID NO: 264 - DNA, 23 bp, Artificial Sequence
  Synthetic Oligonucleotide
tccggtttaagaccagtttacca

SEQ ID NO: 265 - DNA, 20 bp, Artificial Sequence
  Synthetic Oligonucleotide
gtggctcaacattgtgttcc

SEQ ID NO: 266 - DNA, 24 bp, Artificial Sequence
  Synthetic Oligonucleotide
atttcagctgatcagtgggcctcc

SEQ ID NO: 267 - DNA, 20 bp, Artificial Sequence
  Synthetic Oligonucleotide
caatggcctccattttacag

SEQ ID NO: 268 - DNA, 20 bp, Artificial Sequence
  Synthetic Oligonucleotide
tcattcacaaacctggcagt

SEQ ID NO: 269 - DNA, 24 bp, Artificial Sequence
  Synthetic Oligonucleotide
ttccggctgagctgtactcgtctg

SEQ ID NO: 270 - DNA, 20 bp, Artificial Sequence
  Synthetic Oligonucleotide
catacccaatagcccactga

SEQ ID NO: 271 - DNA, 23 bp, Artificial Sequence
  Synthetic Oligonucleotide
ccatgtgctgtaccaagagtttg

SEQ ID NO: 272 - DNA, 26 bp, Artificial Sequence
  Synthetic Oligonucleotide
cagcactgacatcaaagcagccagga

SEQ ID NO: 273 - DNA, 18 bp, Artificial Sequence
  Synthetic Oligonucleotide
cgccgcagaggtggagta

SEQ ID NO: 274 - DNA, 21 bp, Artificial Sequence
  Synthetic Oligonucleotide
agcagacagtggtcagtcctt

SEQ ID NO: 275 - DNA, 24 bp, Artificial Sequence
  Synthetic Oligonucleotide
ctctgctgacactcgagcccacat

SEQ ID NO: 276 - DNA, 20 bp, Artificial Sequence
  Synthetic Oligonucleotide
ctgcatgattctgagcaggt

SEQ ID NO: 277 - DNA, 25 bp, Artificial Sequence
  Synthetic Oligonucleotide
ccatacctcaagtatttgccatcag

SEQ ID NO: 278 - DNA, 29 bp, Artificial Sequence
  Synthetic Oligonucleotide
attgctggagctgcctttcatttagcact

SEQ ID NO: 279 - DNA, 22 bp, Artificial Sequence
  Synthetic Oligonucleotide
agctttgtcccgtgactgtgta

SEQ ID NO: 280 - DNA, 20 bp, Artificial Sequence
  Synthetic Oligonucleotide
ttcaggttgttgcaggagac

SEQ ID NO: 281 - DNA, 27 bp, Artificial Sequence
  Synthetic Oligonucleotide
tgtctccattattgatcggttcatgca

SEQ ID NO: 282 - DNA, 20 bp, Artificial Sequence
  Synthetic Oligonucleotide
catcttcttgggcacacaat

SEQ ID NO: 283 - DNA, 22 bp, Artificial Sequence
  Synthetic Oligonucleotide
aggcttctgcaggagactctgt

SEQ ID NO: 284 - DNA, 25 bp, Artificial Sequence
  Synthetic Oligonucleotide
tcgatccataatgccaacgcacatg

SEQ ID NO: 285 - DNA, 22 bp, Artificial Sequence
  Synthetic Oligonucleotide
gggaaactggctgaacctgtaa

SEQ ID NO: 286 - DNA, 21 bp, Artificial Sequence
  Synthetic Oligonucleotide
gcatgttcgtggcctctaaga

SEQ ID NO: 287 - DNA, 23 bp, Artificial Sequence
  Synthetic Oligonucleotide
aaggagaccatccccctgacggc

SEQ ID NO: 288 - DNA, 22 bp, Artificial Sequence
  Synthetic Oligonucleotide
cggtgtagatgcacagcttctc

SEQ ID NO: 289 - DNA, 27 bp, Artificial Sequence
  Synthetic Oligonucleotide
cctctgtgctacagattatacctttgc

SEQ ID NO: 290 - DNA, 22 bp, Artificial Sequence
  Synthetic Oligonucleotide
tacccgccatccatgatcgcca

SEQ ID NO: 291 - DNA, 18 bp, Artificial Sequence
  Synthetic Oligonucleotide
cactgcagccccaatgct

SEQ ID NO: 292 - DNA, 24 bp, Artificial Sequence
  Synthetic Oligonucleotide
aaagaagatgatgaccgggtttac

SEQ ID NO: 293 - DNA, 24 bp, Artificial Sequence
  Synthetic Oligonucleotide
caaactcaacgtgcaagcctcgga

SEQ ID NO: 294 - DNA, 20 bp, Artificial Sequence
  Synthetic Oligonucleotide
gagcctctggatggtgcaat

SEQ ID NO: 295 - DNA, 25 bp, Artificial Sequence
  Synthetic Oligonucleotide
ggtcaccaagaaacatcagtatgaa

SEQ ID NO: 296 - DNA, 30 bp, Artificial Sequence
  Synthetic Oligonucleotide
cccagataatacaggtggccaacaattcct

SEQ ID NO: 297 - DNA, 25 bp, Artificial Sequence
  Synthetic Oligonucleotide
ttcaatgataatgcaaggactgatc

SEQ ID NO: 298 - DNA, 22 bp, Artificial Sequence
  Synthetic Oligonucleotide
atgctgtggctccttcctaact

SEQ ID NO: 299 - DNA, 30 bp, Artificial Sequence
  Synthetic Oligonucleotide
taccaagcaacctacatgtcaagaaagccc

SEQ ID NO: 300 - DNA, 27 bp, Artificial Sequence
  Synthetic Oligonucleotide
acccaaattgtgatatacaaaaaggtt

SEQ ID NO: 301 - DNA, 20 bp, Artificial Sequence
  Synthetic Oligonucleotide
ggatgacatgcactcagctc

SEQ ID NO: 302 - DNA, 21 bp, Artificial Sequence
  Synthetic Oligonucleotide
ctcccatcccagtggagccaa

SEQ ID NO: 303 - DNA, 20 bp, Artificial Sequence
  Synthetic Oligonucleotide
cctgacatttcccttgtcct

SEQ ID NO: 304 - DNA, 24 bp, Artificial Sequence
  Synthetic Oligonucleotide
gcaggtgtcagcaagtatgatcag

SEQ ID NO: 305 - DNA, 27 bp, Artificial Sequence
  Synthetic Oligonucleotide
cgacaggatattgaccaccgcctcatt

SEQ ID NO: 306 - DNA, 20 bp, Artificial Sequence
  Synthetic Oligonucleotide
tttttccgctgtggtgatga

SEQ ID NO: 307 - DNA, 18 bp, Artificial Sequence
  Synthetic Oligonucleotide
gcccagtgcggagaacag

SEQ ID NO: 308 - DNA, 30 bp, Artificial Sequence
  Synthetic Oligonucleotide
ccagcttgattctcgtctctgcacttaagc

SEQ ID NO: 309 - DNA, 21 bp, Artificial Sequence
  Synthetic Oligonucleotide
aatcacacgcacctggagaac

SEQ ID NO: 310 - DNA, 20 bp, Artificial Sequence
  Synthetic Oligonucleotide
cgtcaggacccaccatgtct

SEQ ID NO: 311 - DNA, 20 bp, Artificial Sequence
  Synthetic Oligonucleotide
cgcggccgagacatggcttg

SEQ ID NO: 312 - DNA, 24 bp, Artificial Sequence
  Synthetic Oligonucleotide
ggttaattggtgacatcctcaaga

SEQ ID NO: 313 - DNA, 21 bp, Artificial Sequence
  Synthetic Oligonucleotide
tccaactaatgccaccaccaa

SEQ ID NO: 314 - DNA, 23 bp, Artificial Sequence
  Synthetic Oligonucleotide
ctgttgactgcagggcaccacca

SEQ ID NO: 315 - DNA, 25 bp, Artificial Sequence
  Synthetic Oligonucleotide
gagagagtgagaccacgaagagact

SEQ ID NO: 316 - DNA, 21 bp, Artificial Sequence
  Synthetic Oligonucleotide
tgtgaaagggaaacacctttg

SEQ ID NO: 317 - DNA, 24 bp, Artificial Sequence
  Synthetic Oligonucleotide
ccaagtcccctatttcccggacct

SEQ ID NO: 318 - DNA, 19 bp, Artificial Sequence
  Synthetic Oligonucleotide
agcacccaaaagggcttag

SEQ ID NO: 319 - DNA, 25 bp, Artificial Sequence
  Synthetic Oligonucleotide
tgtatttcaagacctctgtgcactt

SEQ ID NO: 320 - DNA, 25 bp, Artificial Sequence
  Synthetic Oligonucleotide
tttatgaacctgccctgctcccaca

SEQ ID NO: 321 - DNA, 23 bp, Artificial Sequence
  Synthetic Oligonucleotide
ttagcctgaggaattgctgtgtt

SEQ ID NO: 322 - DNA, 19 bp, Artificial Sequence
  Synthetic Oligonucleotide
ccactgcacacacctcaga

SEQ ID NO: 323 - DNA, 24 bp, Artificial Sequence
  Synthetic Oligonucleotide
ctgttcttggggccctacaccttg

SEQ ID NO: 324 - DNA, 19 bp, Artificial Sequence
  Synthetic Oligonucleotide
caggagtttacctgcccct

SEQ ID NO: 325 - DNA, 20 bp, Artificial Sequence
  Synthetic Oligonucleotide
agatgaagtggaaggcgctt

SEQ ID NO: 326 - DNA, 18 bp, Artificial Sequence
  Synthetic Oligonucleotide
caccgcggccatcctgca

SEQ ID NO: 327 - DNA, 21 bp, Artificial Sequence
  Synthetic Oligonucleotide
tgcctctgtaatcggcaactg

SEQ ID NO: 328 - DNA, 19 bp, Artificial Sequence
  Synthetic Oligonucleotide
atcaccgacagcacagaca

SEQ ID NO: 329 - DNA, 27 bp, Artificial Sequence
  Synthetic Oligonucleotide
ccctgctaccaatatggactccagtca

SEQ ID NO: 330 - DNA, 20 bp, Artificial Sequence
  Synthetic Oligonucleotide
acctgtgtttggatttgcag

SEQ ID NO: 331 - DNA, 20 bp, Artificial Sequence
  Synthetic Oligonucleotide
gacgaagacagtccctggat

SEQ ID NO: 332 - DNA, 24 bp, Artificial Sequence
  Synthetic Oligonucleotide
caccgacagcacagacagaatccc

SEQ ID NO: 333 - DNA, 20 bp, Artificial Sequence
  Synthetic Oligonucleotide
actggggtggaatgtgtctt

SEQ ID NO: 334 - DNA, 22 bp, Artificial Sequence
  Synthetic Oligonucleotide
cacacaaaacagaaccaggact

SEQ ID NO: 335 - DNA, 23 bp, Artificial Sequence
  Synthetic Oligonucleotide
acccagtggaacccaagccattc

SEQ ID NO: 336 - DNA, 21 bp, Artificial Sequence
  Synthetic Oligonucleotide
ctgaagtagcacttccggatt

SEQ ID NO: 337 - DNA, 20 bp, Artificial Sequence
  Synthetic Oligonucleotide
ctcataccagccatccaatg

SEQ ID NO: 338 - DNA, 24 bp, Artificial Sequence
  Synthetic Oligonucleotide
caccaagcccagaggacagttcct

SEQ ID NO: 339 - DNA, 21 bp, Artificial Sequence
  Synthetic Oligonucleotide
ttgggttgaagaaatcagtcc

SEQ ID NO: 340 - DNA, 18 bp, Artificial Sequence
  Synthetic Oligonucleotide
tggttcccagccctgtgt

SEQ ID NO: 341 - DNA, 28 bp, Artificial Sequence
  Synthetic Oligonucleotide
ctccaagcccagattcagattcgagtca

SEQ ID NO: 342 - DNA, 19 bp, Artificial Sequence
  Synthetic Oligonucleotide
ctcctccaccctgggttgt

SEQ ID NO: 343 - DNA, 20 bp, Artificial Sequence
  Synthetic Oligonucleotide
ttcagttgctttgcaggaag

SEQ ID NO: 344 - DNA, 28 bp, Artificial Sequence
  Synthetic Oligonucleotide
ttctgtgcccaccatattcctctagaca

SEQ ID NO: 345 - DNA, 20 bp, Artificial Sequence
  Synthetic Oligonucleotide
ttgatcaaggtcaccagagc

SEQ ID NO: 346 - DNA, 20 bp, Artificial Sequence
  Synthetic Oligonucleotide
gtgcaggctcaggtgaagtg

SEQ ID NO: 347 - DNA, 30 bp, Artificial Sequence
  Synthetic Oligonucleotide
tcagcttctacaactggacagacaacgctg

SEQ ID NO: 348 - DNA, 20 bp, Artificial Sequence
  Synthetic Oligonucleotide
gacctcagggcgattcatga

SEQ ID NO: 349 - DNA, 20 bp, Artificial Sequence
  Synthetic Oligonucleotide
agggtgaggtgcttgagtct

SEQ ID NO: 350 - DNA, 26 bp, Artificial Sequence
  Synthetic Oligonucleotide
ccaacggcaagggaacaagtacttct

SEQ ID NO: 351 - DNA, 19 bp, Artificial Sequence
  Synthetic Oligonucleotide
gggcacagtatcccaggta

SEQ ID NO: 352 - DNA, 20 bp, Artificial Sequence
  Synthetic Oligonucleotide
gggcgtggaacagtttatct

SEQ ID NO: 353 - DNA, 24 bp, Artificial Sequence
  Synthetic Oligonucleotide
agacatctgccccaagaaggacgt

SEQ ID NO: 354 - DNA, 19 bp, Artificial Sequence
  Synthetic Oligonucleotide
cacggtgaaggtttcgagt

SEQ ID NO: 355 - DNA, 18 bp, Artificial Sequence
  Synthetic Oligonucleotide
gagagcgacgcggttgtt

SEQ ID NO: 356 - DNA, 18 bp, Artificial Sequence
  Synthetic Oligonucleotide
tagctgccgctgcggccg

SEQ ID NO: 357 - DNA, 26 bp, Artificial Sequence
  Synthetic Oligonucleotide
gtatggtagatcccggcttattattc

SEQ ID NO: 358 - DNA, 21 bp, Artificial Sequence
  Synthetic Oligonucleotide
tggattggagttctgggaatg

SEQ ID NO: 359 - DNA, 23 bp, Artificial Sequence
  Synthetic Oligonucleotide
actggccgtggcactggacaaca

SEQ ID NO: 360 - DNA, 22 bp, Artificial Sequence
  Synthetic Oligonucleotide
gcttgcactccacaggtacaca

SEQ ID NO: 361 - DNA, 20 bp, Artificial Sequence
  Synthetic Oligonucleotide
tcttgctggctacgcctctt

SEQ ID NO: 362 - DNA, 28 bp, Artificial Sequence
  Synthetic Oligonucleotide
tgtccctgttagacgtcctccgtccata

SEQ ID NO: 363 - DNA, 21 bp, Artificial Sequence
  Synthetic Oligonucleotide
ctgcattgtggcacagttctg

SEQ ID NO: 364 - DNA, 21 bp, Artificial Sequence
  Synthetic Oligonucleotide
aaacgagcagtttgccatcag

SEQ ID NO: 365 - DNA, 24 bp, Artificial Sequence
  Synthetic Oligonucleotide
cctcaccggcatagactggaagcg

SEQ ID NO: 366 - DNA, 20 bp, Artificial Sequence
  Synthetic Oligonucleotide
gttggtgatgttccgaagca

SEQ ID NO: 367 - DNA, 20 bp, Artificial Sequence
  Synthetic Oligonucleotide
ggtgagcagaagtggcctat

SEQ ID NO: 368 - DNA, 23 bp, Artificial Sequence
  Synthetic Oligonucleotide
ctccccgtcgatgccagagaact

SEQ ID NO: 369 - DNA, 20 bp, Artificial Sequence
  Synthetic Oligonucleotide
cttcagtcttggcctgttca

SEQ ID NO: 370 - DNA, 18 bp, Artificial Sequence
  Synthetic Oligonucleotide
gcagtccgctgtgttcaa

SEQ ID NO: 371 - DNA, 24 bp, Artificial Sequence
  Synthetic Oligonucleotide
tgctccactaacaaccctcctgcc

SEQ ID NO: 372 - DNA, 22 bp, Artificial Sequence
  Synthetic Oligonucleotide
ggatcccacacctttaccataa

SEQ ID NO: 373 - DNA, 18 bp, Artificial Sequence
  Synthetic Oligonucleotide
tccagagactgctgaaaa

SEQ ID NO: 374 - DNA, 23 bp, Artificial Sequence
  Synthetic Oligonucleotide
cccgtgacctgaaggctgtcaag

SEQ ID NO: 375 - DNA, 18 bp, Artificial Sequence
  Synthetic Oligonucleotide
tgtgtaagtgcagaacac

SEQ ID NO: 376 - DNA, 20 bp, Artificial Sequence
  Synthetic Oligonucleotide
gagctgaaagacgcacactg

SEQ ID NO: 377 - DNA, 24 bp, Artificial Sequence
  Synthetic Oligonucleotide
aattcctgcatggccagtttcctc

SEQ ID NO: 378 - DNA, 18 bp, Artificial Sequence
  Synthetic Oligonucleotide
gccgctcattgatctcca

SEQ ID NO: 379 - DNA, 21 bp, Artificial Sequence
  Synthetic Oligonucleotide
gcaacactccccatttacctc

SEQ ID NO: 380 - DNA, 24 bp, Artificial Sequence
  Synthetic Oligonucleotide
ttgttctccaccaaagcaaggcaa

SEQ ID NO: 381 - DNA, 20 bp, Artificial Sequence
  Synthetic Oligonucleotide
tgagggggaccattctcttt

SEQ ID NO: 382 - DNA, 20 bp, Artificial Sequence
  Synthetic Oligonucleotide
aagaccgtggatggctacat

SEQ ID NO: 383 - DNA, 24 bp, Artificial Sequence
  Synthetic Oligonucleotide
atgaagatgacctgcccagaagcc

SEQ ID NO: 384 - DNA, 19 bp, Artificial Sequence
  Synthetic Oligonucleotide
agggtcacggatgatctgg

SEQ ID NO: 385 - DNA, 21 bp, Artificial Sequence
  Synthetic Oligonucleotide
tgagtgtcccccggtatcttc

SEQ ID NO: 386 - DNA, 27 bp, Artificial Sequence
  Synthetic Oligonucleotide
tgccaatcccgatgaaattggaaattt

SEQ ID NO: 387 - DNA, 21 bp, Artificial Sequence
  Synthetic Oligonucleotide
cagccgctttcagattttcat

SEQ ID NO: 388 - DNA, 18 bp, Artificial Sequence
  Synthetic Oligonucleotide
gtcggcagaagcaggact

SEQ ID NO: 389 - DNA, 24 bp, Artificial Sequence
  Synthetic Oligonucleotide
ccttctgcccatagtgatcagcga

SEQ ID NO: 390 - DNA, 18 bp, Artificial Sequence
  Synthetic Oligonucleotide
ctactcatgggcgggatg

SEQ ID NO: 391 - DNA, 18 bp, Artificial Sequence
  Synthetic Oligonucleotide
acccatgtaccgtcctcg

SEQ ID NO: 392 - DNA, 24 bp, Artificial Sequence
  Synthetic Oligonucleotide
ccaacccagatgaaatcggcaact

SEQ ID NO: 393 - DNA, 19 bp, Artificial Sequence
  Synthetic Oligonucleotide
ccgccttcaggttctcaat

SEQ ID NO: 394 - DNA, 20 bp, Artificial Sequence
  Synthetic Oligonucleotide
aatgctgcactacgacccta

SEQ ID NO: 395 - DNA, 21 bp, Artificial Sequence
  Synthetic Oligonucleotide
ccttggccgaaatccgcttgt

SEQ ID NO: 396 - DNA, 20 bp, Artificial Sequence
  Synthetic Oligonucleotide
ttggtcacatcctggaagaa

SEQ ID NO: 397 - DNA, 18 bp, Artificial Sequence
  Synthetic Oligonucleotide
agcaacaccagcctcctg

SEQ ID NO: 398 - DNA, 24 bp, Artificial Sequence
  Synthetic Oligonucleotide
cacctcctctccaatgcctgtgaa

SEQ ID NO: 399 - DNA, 20 bp, Artificial Sequence
  Synthetic Oligonucleotide
gggctatggcagaaactcct

SEQ ID NO: 400 - DNA, 18 bp, Artificial Sequence
  Synthetic Oligonucleotide
gggcaggcaaggtttaca

SEQ ID NO: 401 - DNA, 24 bp, Artificial Sequence
  Synthetic Oligonucleotide
atcttagctgcctttggcttccgc

SEQ ID NO: 402 - DNA, 22 bp, Artificial Sequence
  Synthetic Oligonucleotide
gtctttggtcagtccagctttc

SEQ ID NO: 403 - DNA, 22 bp, Artificial Sequence
  Synthetic Oligonucleotide
acttgcctgttcagagcactca

SEQ ID NO: 404 - DNA, 23 bp, Artificial Sequence
  Synthetic Oligonucleotide
tccttcccacccccagtcctgtc

SEQ ID NO: 405 - DNA, 22 bp, Artificial Sequence
  Synthetic Oligonucleotide
tggcaaatccgaattagagtga

SEQ ID NO: 406 - DNA, 24 bp, Artificial Sequence
  Synthetic Oligonucleotide
cacagcctcacttctaaccttctg

SEQ ID NO: 407 - DNA, 23 bp, Artificial Sequence
  Synthetic Oligonucleotide
acccacccaccactgccaagctc

SEQ ID NO: 408 - DNA, 22 bp, Artificial Sequence
  Synthetic Oligonucleotide
ttgaatggcgtggattcaatag

SEQ ID NO: 409 - DNA, 20 bp, Artificial Sequence
  Synthetic Oligonucleotide
gcaacccacgtgtaactgtc

SEQ ID NO: 410 - DNA, 23 bp, Artificial Sequence
  Synthetic Oligonucleotide
ccgggccctgagtaatcgcttaa

SEQ ID NO: 411 - DNA, 20 bp, Artificial Sequence
  Synthetic Oligonucleotide
acaagcccgtaggaacatct

SEQ ID NO: 412 - DNA, 21 bp, Artificial Sequence
  Synthetic Oligonucleotide
tgacaatcagcacacctgcat

SEQ ID NO: 413 - DNA, 20 bp, Artificial Sequence
  Synthetic Oligonucleotide
caggccctcttccgagcggt

SEQ ID NO: 414 - DNA, 23 bp, Artificial Sequence
  Synthetic Oligonucleotide
tgtgactacagccgtgatcctta

SEQ ID NO: 415 - DNA, 21 bp, Artificial Sequence
  Synthetic Oligonucleotide
taaattcactcgtggtgtgga

SEQ ID NO: 416 - DNA, 21 bp, Artificial Sequence
  Synthetic Oligonucleotide
cttcaattggcaagcccaggc

SEQ ID NO: 417 - DNA, 20 bp, Artificial Sequence
  Synthetic Oligonucleotide
gcctcttgtagggccaatag

SEQ ID NO: 418 - DNA, 20 bp, Artificial Sequence
  Synthetic Oligonucleotide
ggatgctggtgacctcttct

SEQ ID NO: 419 - DNA, 25 bp, Artificial Sequence
  Synthetic Oligonucleotide
tccctcacgttgcaacaggaattaa

SEQ ID NO: 420 - DNA, 20 bp, Artificial Sequence
  Synthetic Oligonucleotide
gccaaggcaccaagtaactc

SEQ ID NO: 421 - DNA, 18 bp, Artificial Sequence
  Synthetic Oligonucleotide
ctcccgtcaacagcgttc

SEQ ID NO: 422 - DNA, 24 bp, Artificial Sequence
  Synthetic Oligonucleotide
acactggaccaggagtgcatccag

SEQ ID NO: 423 - DNA, 18 bp, Artificial Sequence
  Synthetic Oligonucleotide
gggtgagtctggccttca

SEQ ID NO: 424 - DNA, 20 bp, Artificial Sequence
  Synthetic Oligonucleotide
actttgcgagaaatgggaac

SEQ ID NO: 425 - DNA, 22 bp, Artificial Sequence
  Synthetic Oligonucleotide
agtgtggcagaccctcgccatt

SEQ ID NO: 426 - DNA, 20 bp, Artificial Sequence
  Synthetic Oligonucleotide
caggtattgctcctcctggt

SEQ ID NO: 427 - DNA, 20 bp, Artificial Sequence
  Synthetic Oligonucleotide
ctgaaggagctccaagacct

SEQ ID NO: 428 - DNA, 22 bp, Artificial Sequence
  Synthetic Oligonucleotide
tgctgatgtgccctctccttgg

SEQ ID NO: 429 - DNA, 20 bp, Artificial Sequence
  Synthetic Oligonucleotide
caaaaccgctgtgtttcttc

SEQ ID NO: 430 - DNA, 18 bp, Artificial Sequence
  Synthetic Oligonucleotide
ccaccataggcagaggca

SEQ ID NO: 431 - DNA, 24 bp, Artificial Sequence
  Synthetic Oligonucleotide
acaccctactccctgtgcctccag

SEQ ID NO: 432 - DNA, 20 bp, Artificial Sequence
  Synthetic Oligonucleotide
agtcgtcgagtgctagggac

SEQ ID NO: 433 - DNA, 20 bp, Artificial Sequence
  Synthetic Oligonucleotide
gaggccagtggtggaaacag

SEQ ID NO: 434 - DNA, 26 bp, Artificial Sequence
  Synthetic Oligonucleotide
agctgatgagtctgccctaccgcctg

SEQ ID NO: 435 - DNA, 18 bp, Artificial Sequence
  Synthetic Oligonucleotide
tccgaggccacagcaaac

SEQ ID NO: 436 - DNA, 18 bp, Artificial Sequence
  Synthetic Oligonucleotide
ctctgtgcgaggctgtca

SEQ ID NO: 437 - DNA, 24 bp, Artificial Sequence
  Synthetic Oligonucleotide
acccatctcgggatccctgatacc

SEQ ID NO: 438 - DNA, 19 bp, Artificial Sequence
  Synthetic Oligonucleotide
ggtaaggactgtgggctgg

SEQ ID NO: 439 - DNA, 20 bp, Artificial Sequence
  Synthetic Oligonucleotide
aaggaagtggtccctctgtg

SEQ ID NO: 440 - DNA, 24 bp, Artificial Sequence
  Synthetic Oligonucleotide
tgaagtctccagctttgcctcagc

SEQ ID NO: 441 - DNA, 20 bp, Artificial Sequence
  Synthetic Oligonucleotide
gacgcagtctttctgtctgg

SEQ ID NO: 442 - DNA, 26 bp, Artificial Sequence
  Synthetic Oligonucleotide
gataaattggtacaagggatcagctt

SEQ ID NO: 443 - DNA, 26 bp, Artificial Sequence
  Synthetic Oligonucleotide
ccagcccacatgtcctgatcatatgc

SEQ ID NO: 444 - DNA, 24 bp, Artificial Sequence
  Synthetic Oligonucleotide
gggtgccaagtaactgactattca

SEQ ID NO: 445 - DNA, 21 bp, Artificial Sequence
  Synthetic Oligonucleotide
atgtggaacccccacctactt

SEQ ID NO: 446 - DNA, 29 bp, Artificial Sequence
  Synthetic Oligonucleotide
agtcccaacagaaacaagaacttcaggcg

SEQ ID NO: 447 - DNA, 22 bp, Artificial Sequence
  Synthetic Oligonucleotide
cagtccacagcacggttatacc

SEQ ID NO: 448 - DNA, 18 bp, Artificial Sequence
  Synthetic Oligonucleotide
tgcctgtggtgggaagct

SEQ ID NO: 449 - DNA, 30 bp, Artificial Sequence
  Synthetic Oligonucleotide
tgacatagcatcatcctttggttcccagtt

SEQ ID NO: 450 - DNA, 19 bp, Artificial Sequence
  Synthetic Oligonucleotide
ggaaaatgcctccggtgtt

SEQ ID NO: 451 - DNA, 24 bp, Artificial Sequence
  Synthetic Oligonucleotide
ggatatttccgtggctcttattca

SEQ ID NO: 452 - DNA, 30 bp, Artificial Sequence
  Synthetic Oligonucleotide
tctccatcaaatcctgtaaactccagagca

SEQ ID NO: 453 - DNA, 25 bp, Artificial Sequence
  Synthetic Oligonucleotide
cttctcatcaaggcagaaaaatctt

SEQ ID NO: 454 - DNA, 20 bp, Artificial Sequence
  Synthetic Oligonucleotide
ggtccctaaaacccatctga

SEQ ID NO: 455 - DNA, 24 bp, Artificial Sequence
  Synthetic Oligonucleotide
tgaacgccaagattcctccattca

SEQ ID NO: 456 - DNA, 20 bp, Artificial Sequence
  Synthetic Oligonucleotide
taatggacccatccctgact

SEQ ID NO: 457 - DNA, 20 bp, Artificial Sequence
  Synthetic Oligonucleotide
ggctggacgtggttttgtct

SEQ ID NO: 458 - DNA, 18 bp, Artificial Sequence
  Synthetic Oligonucleotide
ctgcgcccgctcttcgcg

SEQ ID NO: 459 - DNA, 20 bp, Artificial Sequence
  Synthetic Oligonucleotide
cgctgcagaaaatgaaacga

SEQ ID NO: 460 - DNA, 19 bp, Artificial Sequence
  Synthetic Oligonucleotide
ggctgctttgctgcaactg

SEQ ID NO: 461 - DNA, 24 bp, Artificial Sequence
  Synthetic Oligonucleotide
cgcacagacaagccttactccgcc

SEQ ID NO: 462 - DNA, 19 bp, Artificial Sequence
  Synthetic Oligonucleotide
cagagcgggcagcagaata

SEQ ID NO: 463 - DNA, 19 bp, Artificial Sequence
  Synthetic Oligonucleotide
tctgggaggtgccctactt

SEQ ID NO: 464 - DNA, 24 bp, Artificial Sequence
  Synthetic Oligonucleotide
tgttcctgtccccgaaaaacaacc

SEQ ID NO: 465 - DNA, 19 bp, Artificial Sequence
  Synthetic Oligonucleotide
tggatagggccttggtgtt

SEQ ID NO: 466 - DNA, 20 bp, Artificial Sequence
  Synthetic Oligonucleotide
ggtctgccctagtcatcctg

SEQ ID NO: 467 - DNA, 24 bp, Artificial Sequence
  Synthetic Oligonucleotide
tgcactgctctcctgttcctgtcc

SEQ ID NO: 468 - DNA, 20 bp, Artificial Sequence
  Synthetic Oligonucleotide
gtacccagccttgctctcat

SEQ ID NO: 469 - DNA, 20 bp, Artificial Sequence
  Synthetic Oligonucleotide
cggtacttgagcaatgccta

SEQ ID NO: 470 - DNA, 23 bp, Artificial Sequence
  Synthetic Oligonucleotide
cgggaagaattcgcttccacctg

SEQ ID NO: 471 - DNA, 20 bp, Artificial Sequence
  Synthetic Oligonucleotide
tcgatctcctcatcatctgg

SEQ ID NO: 472 - DNA, 19 bp, Artificial Sequence
  Synthetic Oligonucleotide
accgtatggacagccacag

SEQ ID NO: 473 - DNA, 24 bp, Artificial Sequence
  Synthetic Oligonucleotide
tctcacatgctgtacccaaagcca

SEQ ID NO: 474 - DNA, 21 bp, Artificial Sequence
  Synthetic Oligonucleotide
tgactacaggatcagcgcttc

SEQ ID NO: 475 - DNA, 23 bp, Artificial Sequence
  Synthetic Oligonucleotide
ccccaggatacctaccactacct

SEQ ID NO: 476 - DNA, 20 bp, Artificial Sequence
  Synthetic Oligonucleotide
cccttcagcctgccccaccg

SEQ ID NO: 477 - DNA, 18 bp, Artificial Sequence
  Synthetic Oligonucleotide
tgcgggacttgggaaaga

SEQ ID NO: 478 - DNA, 22 bp, Artificial Sequence
  Synthetic Oligonucleotide
gacatttccagtcctgcagtca

SEQ ID NO: 479 - DNA, 23 bp, Artificial Sequence
  Synthetic Oligonucleotide
tgcctctctgccccaccctttgt

SEQ ID NO: 480 - DNA, 20 bp, Artificial Sequence
  Synthetic Oligonucleotide
ctccgatcgcacacatttgt

SEQ ID NO: 481 - DNA, 21 bp, Artificial Sequence
  Synthetic Oligonucleotide
tccctccactcggaaggacta

SEQ ID NO: 482 - DNA, 27 bp, Artificial Sequence
  Synthetic Oligonucleotide
tctgacactgtccaacttgaccctctt

SEQ ID NO: 483 - DNA, 22 bp, Artificial Sequence
  Synthetic Oligonucleotide
cggttgttgctgatctgtctca

SEQ ID NO: 484 - DNA, 18 bp, Artificial Sequence
  Synthetic Oligonucleotide
tccaccctcctggctttg

SEQ ID NO: 485 - DNA, 23 bp, Artificial Sequence
  Synthetic Oligonucleotide
tcctttcgtcttcgccatgctgg

SEQ ID NO: 486 - DNA, 21 bp, Artificial Sequence
  Synthetic Oligonucleotide
tcactcccacgttcaccttgt

SEQ ID NO: 487 - DNA, 18 bp, Artificial Sequence
  Synthetic Oligonucleotide
gtggccatccagctgacc

SEQ ID NO: 488 - DNA, 21 bp, Artificial Sequence
  Synthetic Oligonucleotide
tcctgcgcctgatgtccaccg

SEQ ID NO: 489 - DNA, 23 bp, Artificial Sequence
  Synthetic Oligonucleotide
cagtggtaggtgatgttctggga

SEQ ID NO: 490 - DNA, 24 bp, Artificial Sequence
  Synthetic Oligonucleotide
cagccaagaactggtataggagct

SEQ ID NO: 491 - DNA, 30 bp, Artificial Sequence
  Synthetic Oligonucleotide
tctcctagccagacgtgtttcttgtccttg

SEQ ID NO: 492 - DNA, 19 bp, Artificial Sequence
  Synthetic Oligonucleotide
aaactggctgccagcattg

SEQ ID NO: 493 - DNA, 20 bp, Artificial Sequence
  Synthetic Oligonucleotide
atgcccagtgttcctgactt

SEQ ID NO: 494 - DNA, 26 bp, Artificial Sequence
  Synthetic Oligonucleotide
cgaaacgctattctcacaggttcagc

SEQ ID NO: 495 - DNA, 20 bp, Artificial Sequence
  Synthetic Oligonucleotide
ctccccattacaagtgctga

SEQ ID NO: 496 - DNA, 23 bp, Artificial Sequence
  Synthetic Oligonucleotide
tctgcagagttggaagcactcta

SEQ ID NO: 497 - DNA, 28 bp, Artificial Sequence
  Synthetic Oligonucleotide
caggatacagctccacagcatcgatgtc

SEQ ID NO: 498 - DNA, 21 bp, Artificial Sequence
  Synthetic Oligonucleotide
gccgaggcttttctaccagaa

SEQ ID NO: 499 - DNA, 20 bp, Artificial Sequence
  Synthetic Oligonucleotide
tcgagtctcccttcaccatt

SEQ ID NO: 500 - DNA, 23 bp, Artificial Sequence
  Synthetic Oligonucleotide
cgacggcatctacggctcaacat

SEQ ID NO: 501 - DNA, 19 bp, Artificial Sequence
  Synthetic Oligonucleotide
gacgtgaagtccgtggaag

SEQ ID NO: 502 - DNA, 21 bp, Artificial Sequence
  Synthetic Oligonucleotide
cgtgagtacacagatgcctcc

SEQ ID NO: 503 - DNA, 24 bp, Artificial Sequence
  Synthetic Oligonucleotide
tcttcagggcctctctcctttcga

SEQ ID NO: 504 - DNA, 18 bp, Artificial Sequence
  Synthetic Oligonucleotide
ccaggatgccaagatgct

SEQ ID NO: 505 - DNA, 23 bp, Artificial Sequence
  Synthetic Oligonucleotide
tggtctgcaagcaagtattcaag

SEQ ID NO: 506 - DNA, 23 bp, Artificial Sequence
  Synthetic Oligonucleotide
tctgcttgggcctcactgcacct

SEQ ID NO: 507 - DNA, 21 bp, Artificial Sequence
  Synthetic Oligonucleotide
gctgattggttgggacaaggt

SEQ ID NO: 508 - DNA, 21 bp, Artificial Sequence
  Synthetic Oligonucleotide
tgggaagcagctgtgtaccat

SEQ ID NO: 509 - DNA, 28 bp, Artificial Sequence
  Synthetic Oligonucleotide
cctcgcgatgctgcctactacagctatc

SEQ ID NO: 510 - DNA, 30 bp, Artificial Sequence
  Synthetic Oligonucleotide
gaaacacttctcacagaaatgatacctatt

SEQ ID NO: 511 - DNA, 18 bp, Artificial Sequence
  Synthetic Oligonucleotide
gtgctacgccaccctgtt

SEQ ID NO: 512 - DNA, 22 bp, Artificial Sequence
  Synthetic Oligonucleotide
ccgatgttcacgcctttgggtc

SEQ ID NO: 513 - DNA, 20 bp, Artificial Sequence
  Synthetic Oligonucleotide
caggggcttctcgtagatgt

SEQ ID NO: 514 - DNA, 18 bp, Artificial Sequence
  Synthetic Oligonucleotide
gggtctgtgccccatgac

SEQ ID NO: 515 - DNA, 25 bp, Artificial Sequence
  Synthetic Oligonucleotide
cctggctgcccaagaagtgttccct

SEQ ID NO: 516 - DNA, 20 bp, Artificial Sequence
  Synthetic Oligonucleotide
tgaccgtgccagcatttaca

SEQ ID NO: 517 - DNA, 20 bp, Artificial Sequence
  Synthetic Oligonucleotide
ctccctaacctccagaatgg

SEQ ID NO: 518 - DNA, 24 bp, Artificial Sequence
  Synthetic Oligonucleotide
actcgcttctggataaccctggca

SEQ ID NO: 519 - DNA, 20 bp, Artificial Sequence
  Synthetic Oligonucleotide
tgtcttgtcgtaggcattgg

SEQ ID NO: 520 - DNA, 20 bp, Artificial Sequence
  Synthetic Oligonucleotide
aaggtttttggattgcaagg

SEQ ID NO: 521 - DNA, 24 bp, Artificial Sequence
  Synthetic Oligonucleotide
accgtcatacatgcccctggaaac

SEQ ID NO: 522 - DNA, 20 bp, Artificial Sequence
  Synthetic Oligonucleotide
gggtgtagctggtacctcgt

SEQ ID NO: 523 - DNA, 20 bp, Artificial Sequence
  Synthetic Oligonucleotide
gatgtgattgaggtgcatgg

SEQ ID NO: 524 - DNA, 24 bp, Artificial Sequence
  Synthetic Oligonucleotide
tgttcatcctggcgctcttcatgt

SEQ ID NO: 525 - DNA, 21 bp, Artificial Sequence
  Synthetic Oligonucleotide
gaactccctggagatgaaacc

SEQ ID NO: 526 - DNA, 20 bp, Artificial Sequence
  Synthetic Oligonucleotide
ttacgcagctcatgctcttg

SEQ ID NO: 527 - DNA, 24 bp, Artificial Sequence
  Synthetic Oligonucleotide
acggctctttactatgcgagggcc

SEQ ID NO: 528 - DNA, 22 bp, Artificial Sequence
  Synthetic Oligonucleotide
gcagctgtaaagagagtggcat

SEQ ID NO: 529 - DNA, 18 bp, Artificial Sequence
  Synthetic Oligonucleotide
tgcagcggctgattgaca

SEQ ID NO: 530 - DNA, 28 bp, Artificial Sequence
  Synthetic Oligonucleotide
tcagatggagacctcgtgccaaattaca

SEQ ID NO: 531 - DNA, 25 bp, Artificial Sequence
  Synthetic Oligonucleotide
caactgttcctggtctacaaactca

SEQ ID NO: 532 - DNA, 20 bp, Artificial Sequence
  Synthetic Oligonucleotide
cctgaacatgaaggagctga

SEQ ID NO: 533 - DNA, 21 bp, Artificial Sequence
  Synthetic Oligonucleotide
tcccgatggtctgcagcagct

SEQ ID NO: 534 - DNA, 19 bp, Artificial Sequence
  Synthetic Oligonucleotide
catcacgtctccgaactcc

SEQ ID NO: 535 - DNA, 20 bp, Artificial Sequence
  Synthetic Oligonucleotide
gctctccatcagctcctgtc

SEQ ID NO: 536 - DNA, 24 bp, Artificial Sequence
  Synthetic Oligonucleotide
ccacatcaacagggaaagctgctg

SEQ ID NO: 537 - DNA, 19 bp, Artificial Sequence
  Synthetic Oligonucleotide
aacacgggcagaaagcact

SEQ ID NO: 538 - DNA, 19 bp, Artificial Sequence
  Synthetic Oligonucleotide
gagttcaagtgccctgacg

SEQ ID NO: 539 - DNA, 28 bp, Artificial Sequence
  Synthetic Oligonucleotide
aacatcatgttcttcttcatgacctcgc

SEQ ID NO: 540 - DNA, 20 bp, Artificial Sequence
  Synthetic Oligonucleotide
agttgtaatggcaggcacag

SEQ ID NO: 541 - DNA, 20 bp, Artificial Sequence
  Synthetic Oligonucleotide
gctcacttcggctaaaatgc

SEQ ID NO: 542 - DNA, 24 bp, Artificial Sequence
  Synthetic Oligonucleotide
accaacgctgacagcatgcatttc

SEQ ID NO: 543 - DNA, 21 bp, Artificial Sequence
  Synthetic Oligonucleotide
tcagctccattgaatgtgaaa

SEQ ID NO: 544 - DNA, 19 bp, Artificial Sequence
  Synthetic Oligonucleotide
cactgaggtccgggtgaca

SEQ ID NO: 545 - DNA, 21 bp, Artificial Sequence
  Synthetic Oligonucleotide
cacctggctgtcagcctgccg

SEQ ID NO: 546 - DNA, 21 bp, Artificial Sequence
  Synthetic Oligonucleotide
gtaggttgccgcacagacttc

SEQ ID NO: 547 - DNA, 19 bp, Artificial Sequence
  Synthetic Oligonucleotide
gttttccaggtcggagacg

SEQ ID NO: 548 - DNA, 24 bp, Artificial Sequence
  Synthetic Oligonucleotide
ctttgcagctactgcctccggtct

SEQ ID NO: 549 - DNA, 18 bp, Artificial Sequence
  Synthetic Oligonucleotide
agcatccagggtgttcca

SEQ ID NO: 550 - DNA, 20 bp, Artificial Sequence
  Synthetic Oligonucleotide
ggccgagatctacaaaaacg

SEQ ID NO: 551 - DNA, 21 bp, Artificial Sequence
  Synthetic Oligonucleotide
ccccgtggagggagctttctc

SEQ ID NO: 552 - DNA, 20 bp, Artificial Sequence
  Synthetic Oligonucleotide
gcaggaagtccgaatacaca

SEQ ID NO: 553 - DNA, 24 bp, Artificial Sequence
  Synthetic Oligonucleotide
gtacatgatcccctgtgagaaggt

SEQ ID NO: 554 - DNA, 22 bp, Artificial Sequence
  Synthetic Oligonucleotide
accctgcccgcgatcacactga

SEQ ID NO: 555 - DNA, 21 bp, Artificial Sequence
  Synthetic Oligonucleotide
gggacagcttgtagcctttgc

SEQ ID NO: 556 - DNA, 20 bp, Artificial Sequence
  Synthetic Oligonucleotide
gcaagttccaacctggaaag

SEQ ID NO: 557 - DNA, 24 bp, Artificial Sequence
  Synthetic Oligonucleotide
tggctacatccttgacaaagccga

SEQ ID NO: 558 - DNA, 20 bp, Artificial Sequence
  Synthetic Oligonucleotide
catcgcttcctcgtcataga

SEQ ID NO: 559 - DNA, 23 bp, Artificial Sequence
  Synthetic Oligonucleotide
gggaggcttatctcactgagtga

SEQ ID NO: 560 - DNA, 29 bp, Artificial Sequence
  Synthetic Oligonucleotide
ttgaggcccagagcagtctaccagattct

SEQ ID NO: 561 - DNA, 19 bp, Artificial Sequence
  Synthetic Oligonucleotide
ccattgcagccttcattgc

SEQ ID NO: 562 - DNA, 21 bp, Artificial Sequence
  Synthetic Oligonucleotide
tgtctcactgagcgagcagaa

SEQ ID NO: 563 - DNA, 24 bp, Artificial Sequence
  Synthetic Oligonucleotide
cttgaggacgcgaacagtccacca

SEQ ID NO: 564 - DNA, 19 bp, Artificial Sequence
  Synthetic Oligonucleotide
accattgcagccctgattg

SEQ ID NO: 565 - DNA, 21 bp, Artificial Sequence
  Synthetic Oligonucleotide
atgccctggtaatgtctgcat

SEQ ID NO: 566 - DNA, 24 bp, Artificial Sequence
  Synthetic Oligonucleotide
cagccacaaagccagcgtcattgt

SEQ ID NO: 567 - DNA, 21 bp, Artificial Sequence
  Synthetic Oligonucleotide
gcgaccacaagccttatcaag

SEQ ID NO: 568 - DNA, 21 bp, Artificial Sequence
  Synthetic Oligonucleotide
aagcatcttcctgttcttgga

SEQ ID NO: 569 - DNA, 24 bp, Artificial Sequence
  Synthetic Oligonucleotide
tatgtgctgcagaactccacgctg

SEQ ID NO: 570 - DNA, 20 bp, Artificial Sequence
  Synthetic Oligonucleotide
aatcccatatcccagatgga

SEQ ID NO: 571 - DNA, 19 bp, Artificial Sequence
  Synthetic Oligonucleotide
gagctacagatgcccatgc

SEQ ID NO: 572 - DNA, 24 bp, Artificial Sequence
  Synthetic Oligonucleotide
ttcttcgaaagccatgttgccaga

SEQ ID NO: 573 - DNA, 20 bp, Artificial Sequence
  Synthetic Oligonucleotide
tttgagatgcttgacgttgg

SEQ ID NO: 574 - DNA, 20 bp, Artificial Sequence
  Synthetic Oligonucleotide
tgaccgcttctaccccaatg

SEQ ID NO: 575 - DNA, 28 bp, Artificial Sequence
  Synthetic Oligonucleotide
ctgaaactggaacacaaccacccacaag

SEQ ID NO: 576 - DNA, 22 bp, Artificial Sequence
  Synthetic Oligonucleotide
aggataaggccaaccatgatgt

SEQ ID NO: 577 - DNA, 19 bp, Artificial Sequence
  Synthetic Oligonucleotide
ggtgcctactccattgtgg

SEQ ID NO: 578 - DNA, 24 bp, Artificial Sequence
  Synthetic Oligonucleotide
tactccagcaggcacacaaacacg

SEQ ID NO: 579 - DNA, 20 bp, Artificial Sequence
  Synthetic Oligonucleotide
gtggagcccttcttcctctt

SEQ ID NO: 580 - DNA, 22 bp, Artificial Sequence
  Synthetic Oligonucleotide
ccagctttgtgcctgtcactat

SEQ ID NO: 581 - DNA, 25 bp, Artificial Sequence
  Synthetic Oligonucleotide
ctcatgccaccactgccaacacctc

SEQ ID NO: 582 - DNA, 20 bp, Artificial Sequence
  Synthetic Oligonucleotide
gggaatgtggtagcccaaga

SEQ ID NO: 583 - DNA, 20 bp, Artificial Sequence
  Synthetic Oligonucleotide
ccgtgttcaagaggaagctc

SEQ ID NO: 584 - DNA, 24 bp, Artificial Sequence
  Synthetic Oligonucleotide
ttttctcaactcctccacaaggca

SEQ ID NO: 585 - DNA, 20 bp, Artificial Sequence
  Synthetic Oligonucleotide
agtgggatcacagggtgaag

SEQ ID NO: 586 - DNA, 30 bp, Artificial Sequence
  Synthetic Oligonucleotide
agaacaaggacaacatagatccttacatat

SEQ ID NO: 587 - DNA, 26 bp, Artificial Sequence
  Synthetic Oligonucleotide
cacaccctttggaagtggacccagaa

SEQ ID NO: 588 - DNA, 19 bp, Artificial Sequence
  Synthetic Oligonucleotide
gcaaacctcatgccaatgc

SEQ ID NO: 589 - DNA, 20 bp, Artificial Sequence
  Synthetic Oligonucleotide
tgctcattcttgaggagcat

SEQ ID NO: 590 - DNA, 24 bp, Artificial Sequence
  Synthetic Oligonucleotide
cagcacccttggcagtttcgaaat

SEQ ID NO: 591 - DNA, 20 bp, Artificial Sequence
  Synthetic Oligonucleotide
gtggctgcattagtgtccat

SEQ ID NO: 592 - DNA, 22 bp, Artificial Sequence
  Synthetic Oligonucleotide
cgctgacatcatgaatgttcct

SEQ ID NO: 593 - DNA, 25 bp, Artificial Sequence
  Synthetic Oligonucleotide
tcatatccaaactcgcctccagccg

SEQ ID NO: 594 - DNA, 24 bp, Artificial Sequence
  Synthetic Oligonucleotide
tctctttcagcaacgatgtgtctt

SEQ ID NO: 595 - DNA, 20 bp, Artificial Sequence
  Synthetic Oligonucleotide
aaatgtcctcctcgactgct

SEQ ID NO: 596 - DNA, 24 bp, Artificial Sequence
  Synthetic Oligonucleotide
atcactggaactcctcggtcggac

SEQ ID NO: 597 - DNA, 20 bp, Artificial Sequence
  Synthetic Oligonucleotide
tgaatgccatctttcttcca

SEQ ID NO: 598 - DNA, 20 bp, Artificial Sequence
  Synthetic Oligonucleotide
ggtcaccgttggtgtcatca

SEQ ID NO: 599 - DNA, 26 bp, Artificial Sequence
  Synthetic Oligonucleotide
cagccacgatgaccactaccagcact

SEQ ID NO: 600 - DNA, 18 bp, Artificial Sequence
  Synthetic Oligonucleotide
gagcgtcgggtgcaaatc

SEQ ID NO: 601 - DNA, 24 bp, Artificial Sequence
  Synthetic Oligonucleotide
atggagatgtggtcattcctagtg

SEQ ID NO: 602 - DNA, 26 bp, Artificial Sequence
  Synthetic Oligonucleotide
tgcttcctcccactatctgaaaataa

SEQ ID NO: 603 - DNA, 22 bp, Artificial Sequence
  Synthetic Oligonucleotide
caccaccccaagtatccgtaag

SEQ ID NO: 604 - DNA, 21 bp, Artificial Sequence
  Synthetic Oligonucleotide
gccgccacaagactaaggaat

SEQ ID NO: 605 - DNA, 24 bp, Artificial Sequence
  Synthetic Oligonucleotide
agctgcccgtctttctcagccagc

SEQ ID NO: 606 - DNA, 20 bp, Artificial Sequence
  Synthetic Oligonucleotide
cgatgttcccttcgatggag

SEQ ID NO: 607 - DNA, 18 bp, Artificial Sequence
  Synthetic Oligonucleotide
tgcggatcatccggaatg

SEQ ID NO: 608 - DNA, 25 bp, Artificial Sequence
  Synthetic Oligonucleotide
aattggaatccacgagcatgccagc

SEQ ID NO: 609 - DNA, 22 bp, Artificial Sequence
  Synthetic Oligonucleotide
tcctttgatgcctggtaagtca

SEQ ID NO: 610 - DNA, 22 bp, Artificial Sequence
  Synthetic Oligonucleotide
cttgtggagatcacccaatcag

SEQ ID NO: 611 - DNA, 21 bp, Artificial Sequence
  Synthetic Oligonucleotide
ctatgcccgggactcgggcct

SEQ ID NO: 612 - DNA, 19 bp, Artificial Sequence
  Synthetic Oligonucleotide
cccgcctggatctcaaact

SEQ ID NO: 613 - DNA, 27 bp, Artificial Sequence
  Synthetic Oligonucleotide
ttgctataactaagtgcttctccaaga

SEQ ID NO: 614 - DNA, 22 bp, Artificial Sequence
  Synthetic Oligonucleotide
cccaactgagtccccagcacct

SEQ ID NO: 615 - DNA, 22 bp, Artificial Sequence
  Synthetic Oligonucleotide
gtggaatggcagctcactgtag

SEQ ID NO: 616 - DNA, 22 bp, Artificial Sequence
  Synthetic Oligonucleotide
gggagaacgggatcaataggat

SEQ ID NO: 617 - DNA, 24 bp, Artificial Sequence
  Synthetic Oligonucleotide
ctcattgggcaccagcaggtttcc

SEQ ID NO: 618 - DNA, 21 bp, Artificial Sequence
  Synthetic Oligonucleotide
gcatcagccagtcctcaaact

SEQ ID NO: 619 - DNA, 19 bp, Artificial Sequence
  Synthetic Oligonucleotide
cacaatggcggctctgaag

SEQ ID NO: 620 - DNA, 23 bp, Artificial Sequence
  Synthetic Oligonucleotide
aagttacgctgcgcgacagccaa

SEQ ID NO: 621 - DNA, 26 bp, Artificial Sequence
  Synthetic Oligonucleotide
acacaaacactgtctgtacctgaaga

SEQ ID NO: 622 - DNA, 20 bp, Artificial Sequence
  Synthetic Oligonucleotide
caagcagtcaaggagaacca

SEQ ID NO: 623 - DNA, 22 bp, Artificial Sequence
  Synthetic Oligonucleotide
ttcttctgtctcccgccgcttc

SEQ ID NO: 624 - DNA, 20 bp, Artificial Sequence
  Synthetic Oligonucleotide
agttttgctcgcctcatctt

SEQ ID NO: 625 - DNA, 20 bp, Artificial Sequence
  Synthetic Oligonucleotide
tccaattccagcatcactgt

SEQ ID NO: 626 - DNA, 25 bp, Artificial Sequence
  Synthetic Oligonucleotide
agaaaagctgtttgtctccccagca

SEQ ID NO: 627 - DNA, 20 bp, Artificial Sequence
  Synthetic Oligonucleotide
ggcagtgaaggcgataaagt

SEQ ID NO: 628 - DNA, 20 bp, Artificial Sequence
  Synthetic Oligonucleotide
tgacaactaccagccgtacc

SEQ ID NO: 629 - DNA, 22 bp, Artificial Sequence
  Synthetic Oligonucleotide
agtgccgcactcctcgtcctct

SEQ ID NO: 630 - DNA, 21 bp, Artificial Sequence
  Synthetic Oligonucleotide
gggactagcgcagtactcatc

SEQ ID NO: 631 - DNA, 20 bp, Artificial Sequence
  Synthetic Oligonucleotide
gattcagacgaggatgagcc

SEQ ID NO: 632 - DNA, 24 bp, Artificial Sequence
  Synthetic Oligonucleotide
aaagtccatttgccactgatggca

SEQ ID NO: 633 - DNA, 20 bp, Artificial Sequence
  Synthetic Oligonucleotide
cacctcttgctgtccctttg

SEQ ID NO: 634 - DNA, 19 bp, Artificial Sequence
  Synthetic Oligonucleotide
aggacgcaaggagggtttg

SEQ ID NO: 635 - DNA, 29 bp, Artificial Sequence
  Synthetic Oligonucleotide
cagtgcctacagtctcgagtctgccagtg

SEQ ID NO: 636 - DNA, 21 bp, Artificial Sequence
  Synthetic Oligonucleotide
gatgtccgccgagtccttact

SEQ ID NO: 637 - DNA, 21 bp, Artificial Sequence
  Synthetic Oligonucleotide
tgcacagagggtgtgggttac

SEQ ID NO: 638 - DNA, 29 bp, Artificial Sequence
  Synthetic Oligonucleotide
caatgcttccaacaatttgtttgcttgcc

SEQ ID NO: 639 - DNA, 28 bp, Artificial Sequence
  Synthetic Oligonucleotide
tcttcatctgatttacaagctgtacatg

SEQ ID NO: 640 - DNA, 24 bp, Artificial Sequence
  Synthetic Oligonucleotide
ctctgagacagtgcttcgatgact

SEQ ID NO: 641 - DNA, 23 bp, Artificial Sequence
  Synthetic Oligonucleotide
cagacttggtgccctttgactcc

SEQ ID NO: 642 - DNA, 19 bp, Artificial Sequence
  Synthetic Oligonucleotide
ccatgaggcccaacttcct

SEQ ID NO: 643 - DNA, 20 bp, Artificial Sequence
  Synthetic Oligonucleotide
cctggatctcccaggtatca

SEQ ID NO: 644 - DNA, 24 bp, Artificial Sequence
  Synthetic Oligonucleotide
acctttcccatccttggcaccttc

SEQ ID NO: 645 - DNA, 20 bp, Artificial Sequence
  Synthetic Oligonucleotide
tgcaatgacttgacgacctc

SEQ ID NO: 646 - DNA, 22 bp, Artificial Sequence
  Synthetic Oligonucleotide
tggcactactgcatgattgaca

SEQ ID NO: 647 - DNA, 21 bp, Artificial Sequence
  Synthetic Oligonucleotide
cagggccatgacaatcgccaa

SEQ ID NO: 648 - DNA, 19 bp, Artificial Sequence
  Synthetic Oligonucleotide
cctgccgcattgttttcag

SEQ ID NO: 649 - DNA, 19 bp, Artificial Sequence
  Synthetic Oligonucleotide
aaatcgctgggaacaagtg

SEQ ID NO: 650 - DNA, 24 bp, Artificial Sequence
  Synthetic Oligonucleotide
cgccctggctcaacttttccttaa

SEQ ID NO: 651 - DNA, 20 bp, Artificial Sequence
  Synthetic Oligonucleotide
aatgcgtatctgtccacgac

SEQ ID NO: 652 - DNA, 20 bp, Artificial Sequence
  Synthetic Oligonucleotide
agacatcagctcctggttca

SEQ ID NO: 653 - DNA, 26 bp, Artificial Sequence
  Synthetic Oligonucleotide
cgaggccattgacttcatagactcca

SEQ ID NO: 654 - DNA, 20 bp, Artificial Sequence
  Synthetic Oligonucleotide
gacaaacacccttcctccag

SEQ ID NO: 655 - DNA, 20 bp, Artificial Sequence
  Synthetic Oligonucleotide
tatccctgtggaggacaacc

SEQ ID NO: 656 - DNA, 24 bp, Artificial Sequence
  Synthetic Oligonucleotide
cctcctggaaccaggcactgatct

SEQ ID NO: 657 - DNA, 20 bp, Artificial Sequence
  Synthetic Oligonucleotide
cacccagtcaatgaagccta

SEQ ID NO: 658 - DNA, 20 bp, Artificial Sequence
  Synthetic Oligonucleotide
acacatggagtgcttctgga

SEQ ID NO: 659 - DNA, 24 bp, Artificial Sequence
  Synthetic Oligonucleotide
atcagcccacttgaccacccagtt

SEQ ID NO: 660 - DNA, 19 bp, Artificial Sequence
  Synthetic Oligonucleotide
ctcttgcctgtgcttccac

SEQ ID NO: 661 - DNA, 20 bp, Artificial Sequence
  Synthetic Oligonucleotide
agcatgacacggagatgaag

SEQ ID NO: 662 - DNA, 24 bp, Artificial Sequence
  Synthetic Oligonucleotide
cacctgaagcggcacttcatgttc

SEQ ID NO: 663 - DNA, 20 bp, Artificial Sequence
  Synthetic Oligonucleotide
aataccaggcacaggtggtt

SEQ ID NO: 664 - DNA, 20 bp, Artificial Sequence
  Synthetic Oligonucleotide
actccctctacccttgagca

SEQ ID NO: 665 - DNA, 24 bp, Artificial Sequence
  Synthetic Oligonucleotide
cagaagaacagctcagggacccct

SEQ ID NO: 666 - DNA, 20 bp, Artificial Sequence
  Synthetic Oligonucleotide
caggcctcagttccttcagt

SEQ ID NO: 667 - DNA, 20 bp, Artificial Sequence
  Synthetic Oligonucleotide
tgccacctggacatcatttg

SEQ ID NO: 668 - DNA, 23 bp, Artificial Sequence
  Synthetic Oligonucleotide
cactcccgagcacgttgttccgt

SEQ ID NO: 669 - DNA, 21 bp, Artificial Sequence
  Synthetic Oligonucleotide
tggacctagggcttccaagtc

SEQ ID NO: 670 - DNA, 20 bp, Artificial Sequence
  Synthetic Oligonucleotide
tacatctccaaacccatcca

SEQ ID NO: 671 - DNA, 24 bp, Artificial Sequence
  Synthetic Oligonucleotide
caacctcaagcagcggtcttcatg

SEQ ID NO: 672 - DNA, 20 bp, Artificial Sequence
  Synthetic Oligonucleotide
ttgccactgacagtcacctt

SEQ ID NO: 673 - DNA, 20 bp, Artificial Sequence
  Synthetic Oligonucleotide
actacatctccacgcccact

SEQ ID NO: 674 - DNA, 25 bp, Artificial Sequence
  Synthetic Oligonucleotide
cctcagacacttccagtgcaggttg

SEQ ID NO: 675 - DNA, 20 bp, Artificial Sequence
  Synthetic Oligonucleotide
cagcagacgaacaccttcat

SEQ ID NO: 676 - DNA, 18 bp, Artificial Sequence
  Synthetic Oligonucleotide
ggagcccgtatcctggag

SEQ ID NO: 677 - DNA, 24 bp, Artificial Sequence
  Synthetic Oligonucleotide
ccctcaaccccaagttcctgagtg

SEQ ID NO: 678 - DNA, 21 bp, Artificial Sequence
  Synthetic Oligonucleotide
ggatagatcaccaagcccttc

SEQ ID NO: 679 - DNA, 23 bp, Artificial Sequence
  Synthetic Oligonucleotide
tgacattatcatcccgctaagga

SEQ ID NO: 680 - DNA, 24 bp, Artificial Sequence
  Synthetic Oligonucleotide
cggacagcgtcttctgccctcact

SEQ ID NO: 681 - DNA, 21 bp, Artificial Sequence
  Synthetic Oligonucleotide
gtagtccccgctgaccttctc

SEQ ID NO: 682 - DNA, 20 bp, Artificial Sequence
  Synthetic Oligonucleotide
ttgaacagagcctgaccaag

SEQ ID NO: 683 - DNA, 28 bp, Artificial Sequence
  Synthetic Oligonucleotide
tgatgctttctccagaaactcgaactca

SEQ ID NO: 684 - DNA, 20 bp, Artificial Sequence
  Synthetic Oligonucleotide
tgttgagattcctcgcagtt

SEQ ID NO: 685 - DNA, 20 bp, Artificial Sequence
  Synthetic Oligonucleotide
tgtcgatggacttccagaac

SEQ ID NO: 686 - DNA, 18 bp, Artificial Sequence
  Synthetic Oligonucleotide
cacctgggcagctgccaa

SEQ ID NO: 687 - DNA, 19 bp, Artificial Sequence
  Synthetic Oligonucleotide
attgggacagcttggatca

SEQ ID NO: 688 - DNA, 18 bp, Artificial Sequence
  Synthetic Oligonucleotide
tcaatggccggacgaaag

SEQ ID NO: 689 - DNA, 26 bp, Artificial Sequence
  Synthetic Oligonucleotide
cattgcccggataacaagcaaccatg

SEQ ID NO: 690 - DNA, 28 bp, Artificial Sequence
  Synthetic Oligonucleotide
tttggattatcaacatgacgtacataac

SEQ ID NO: 691 - DNA, 18 bp, Artificial Sequence
  Synthetic Oligonucleotide
gctggtcctctactgcgg

SEQ ID NO: 692 - DNA, 24 bp, Artificial Sequence
  Synthetic Oligonucleotide
ccggctgggcaaatactacgtcaa

SEQ ID NO: 693 - DNA, 20 bp, Artificial Sequence
  Synthetic Oligonucleotide
ccaccattgccttagacctc

SEQ ID NO: 694 - DNA, 19 bp, Artificial Sequence
  Synthetic Oligonucleotide
gtccccgctgcagatctct

SEQ ID NO: 695 - DNA, 23 bp, Artificial Sequence
  Synthetic Oligonucleotide
cggatcctttcctcactcgccca

SEQ ID NO: 696 - DNA, 24 bp, Artificial Sequence
  Synthetic Oligonucleotide
ctccagcttagggtagttgtccat

SEQ ID NO: 697 - DNA, 20 bp, Artificial Sequence
  Synthetic Oligonucleotide
ccatgtggatgaatgaggtg

SEQ ID NO: 698 - DNA, 24 bp, Artificial Sequence
  Synthetic Oligonucleotide
acccagtctcaccttctccccacc

SEQ ID NO: 699 - DNA, 20 bp, Artificial Sequence
  Synthetic Oligonucleotide
tgcctgagaagaggtgaggt

SEQ ID NO: 700 - DNA, 20 bp, Artificial Sequence
  Synthetic Oligonucleotide
aaagtggtgaatgccatttg

SEQ ID NO: 701 - DNA, 28 bp, Artificial Sequence
  Synthetic Oligonucleotide
cctcaaatgccaggtcagctatatcctg

SEQ ID NO: 702 - DNA, 20 bp, Artificial Sequence
  Synthetic Oligonucleotide
gtgaggcttcctccctgata

SEQ ID NO: 703 - DNA, 23 bp, Artificial Sequence
  Synthetic Oligonucleotide
gatctaagatggcgactgtcgaa

SEQ ID NO: 704 - DNA, 27 bp, Artificial Sequence
  Synthetic Oligonucleotide
accacccctactcctaatcccccgact

SEQ ID NO: 705 - DNA, 25 bp, Artificial Sequence
  Synthetic Oligonucleotide
ttagattccgttttctcctcttctg

SEQ ID NO: 706 - DNA, 18 bp, Artificial Sequence
  Synthetic Oligonucleotide
aagccgcggttgaatgtg

SEQ ID NO: 707 - DNA, 25 bp, Artificial Sequence
  Synthetic Oligonucleotide
tgaccctctccctctctggatggca

SEQ ID NO: 708 - DNA, 20 bp, Artificial Sequence
  Synthetic Oligonucleotide
tgacgccagcttcaatgatg

SEQ ID NO: 709 - DNA, 20 bp, Artificial Sequence
  Synthetic Oligonucleotide
gacaggaggcctctatcctg

SEQ ID NO: 710 - DNA, 22 bp, Artificial Sequence
  Synthetic Oligonucleotide
caccccaccctccacctcaatc

SEQ ID NO: 711 - DNA, 20 bp, Artificial Sequence
  Synthetic Oligonucleotide
gtgaggtaggtctggggaag

SEQ ID NO: 712 - DNA, 25 bp, Artificial Sequence
  Synthetic Oligonucleotide
gctagtactttgatgctcccttgat

SEQ ID NO: 713 - DNA, 22 bp, Artificial Sequence
  Synthetic Oligonucleotide
ccagagagcctccctgcagcca

SEQ ID NO: 714 - DNA, 20 bp, Artificial Sequence
  Synthetic Oligonucleotide
gaacagctggaggccaagtc

SEQ ID NO: 715 - DNA, 20 bp, Artificial Sequence
  Synthetic Oligonucleotide
tggcctacctcttcaccatc

SEQ ID NO: 716 - DNA, 24 bp, Artificial Sequence
  Synthetic Oligonucleotide
tcaacagcctccaaggcttcttca

SEQ ID NO: 717 - DNA, 21 bp, Artificial Sequence
  Synthetic Oligonucleotide
tgaggaggcagtagaccaaga

SEQ ID NO: 718 - DNA, 22 bp, Artificial Sequence
  Synthetic Oligonucleotide
ggcagtgtcactgagtccttga

SEQ ID NO: 719 - DNA, 18 bp, Artificial Sequence
  Synthetic Oligonucleotide
atcctcccctgccccgcg

SEQ ID NO: 720 - DNA, 18 bp, Artificial Sequence
  Synthetic Oligonucleotide
tgcactgtgcgtcccaat

SEQ ID NO: 721 - DNA, 20 bp, Artificial Sequence
  Synthetic Oligonucleotide
caaggccgtgaacgagaagt

SEQ ID NO: 722 - DNA, 26 bp, Artificial Sequence
  Synthetic Oligonucleotide
ctgcaactgcctcctgctcaaagtca

SEQ ID NO: 723 - DNA, 18 bp, Artificial Sequence
  Synthetic Oligonucleotide
cggtcacggagccaatct

SEQ ID NO: 724 - DNA, 20 bp, Artificial Sequence
  Synthetic Oligonucleotide
agccccagcaactacagtct

SEQ ID NO: 725 - DNA, 23 bp, Artificial Sequence
  Synthetic Oligonucleotide
cactgacatcatggctggccttg

SEQ ID NO: 726 - DNA, 20 bp, Artificial Sequence
  Synthetic Oligonucleotide
tgttcaaaggttgaccatgc

SEQ ID NO: 727 - DNA, 21 bp, Artificial Sequence
  Synthetic Oligonucleotide
aagccttggagggtttcattg

SEQ ID NO: 728 - DNA, 23 bp, Artificial Sequence
  Synthetic Oligonucleotide
tgtcgccatcttgggtcaccacg

SEQ ID NO: 729 - DNA, 25 bp, Artificial Sequence
  Synthetic Oligonucleotide
tgctgatgttttctgacagaaagat

SEQ ID NO: 730 - DNA, 20 bp, Artificial Sequence
  Synthetic Oligonucleotide
gggccctccagaacaatgat

SEQ ID NO: 731 - DNA, 25 bp, Artificial Sequence
  Synthetic Oligonucleotide
ccgctctcatcgcagtcaggatcat

SEQ ID NO: 732 - DNA, 21 bp, Artificial Sequence
  Synthetic Oligonucleotide
tgcactgcttggccttaaaga

SEQ ID NO: 733 - DNA, 21 bp, Artificial Sequence
  Synthetic Oligonucleotide
cgcctgttcaccaagattgac

SEQ ID NO: 734 - DNA, 20 bp, Artificial Sequence
  Synthetic Oligonucleotide
tgcgcccgatgagatcaccg

SEQ ID NO: 735 - DNA, 18 bp, Artificial Sequence
  Synthetic Oligonucleotide
gtggcgtgcctcgaagtc

SEQ ID NO: 736 - DNA, 18 bp, Artificial Sequence
  Synthetic Oligonucleotide
caaccaggcagctccatc

SEQ ID NO: 737 - DNA, 24 bp, Artificial Sequence
  Synthetic Oligonucleotide
cacctgatgcatgatggacactgc

SEQ ID NO: 738 - DNA, 19 bp, Artificial Sequence
  Synthetic Oligonucleotide
gtaatgctgtccacggtgc

SEQ ID NO: 739 - DNA, 20 bp, Artificial Sequence
  Synthetic Oligonucleotide
tgaacggggtatcctcctta

SEQ ID NO: 740 - DNA, 24 bp, Artificial Sequence
  Synthetic Oligonucleotide
cgtcccatttgagcctgtcaatgt

SEQ ID NO: 741 - DNA, 20 bp, Artificial Sequence
  Synthetic Oligonucleotide
aggtacctctcggtcagtgg

SEQ ID NO: 742 - DNA, 18 bp, Artificial Sequence
  Synthetic Oligonucleotide
actggtcctccatcggct

SEQ ID NO: 743 - DNA, 24 bp, Artificial Sequence
  Synthetic Oligonucleotide
ccttgcacctcaaaccaaagctcc

SEQ ID NO: 744 - DNA, 21 bp, Artificial Sequence
  Synthetic Oligonucleotide
ccagtgtagcatgagtgctga

SEQ ID NO: 745 - DNA, 20 bp, Artificial Sequence
  Synthetic Oligonucleotide
actgtggcacttaggggaga

SEQ ID NO: 746 - DNA, 24 bp, Artificial Sequence
  Synthetic Oligonucleotide
ctgcctctgcccaaagcaaatgtc

SEQ ID NO: 747 - DNA, 20 bp, Artificial Sequence
  Synthetic Oligonucleotide
agtggaaatgtgtcctggct

SEQ ID NO: 748 - DNA, 23 bp, Artificial Sequence
  Synthetic Oligonucleotide
cggttatgtcatgccagatacac

SEQ ID NO: 749 - DNA, 25 bp, Artificial Sequence
  Synthetic Oligonucleotide
cctcaaaggtactccctcctcccgg

SEQ ID NO: 750 - DNA, 24 bp, Artificial Sequence
  Synthetic Oligonucleotide
gaactgagacccactgaagaaagg

SEQ ID NO: 751 - DNA, 20 bp, Artificial Sequence
  Synthetic Oligonucleotide
gtccaggtggatgtgaaaga

SEQ ID NO: 752 - DNA, 21 bp, Artificial Sequence
  Synthetic Oligonucleotide
cagcaggccctcaaggagctg

SEQ ID NO: 753 - DNA, 20 bp, Artificial Sequence
  Synthetic Oligonucleotide
cggccaggatacacatctta

SEQ ID NO: 754 - DNA, 19 bp, Artificial Sequence
  Synthetic Oligonucleotide
tggccttcttcaccagcta

SEQ ID NO: 755 - DNA, 24 bp, Artificial Sequence
  Synthetic Oligonucleotide
aggccacggtgctctccatgtact

SEQ ID NO: 756 - DNA, 20 bp, Artificial Sequence
  Synthetic Oligonucleotide
caaggatcccctgctcatac

SEQ ID NO: 757 - DNA, 28 bp, Artificial Sequence
  Synthetic Oligonucleotide
ataacaaagtgtagctctgacatgaatg

SEQ ID NO: 758 - DNA, 30 bp, Artificial Sequence
  Synthetic Oligonucleotide
ttgtttgcatggacagtgcatctatctggt

SEQ ID NO: 759 - DNA, 24 bp, Artificial Sequence
  Synthetic Oligonucleotide
cacacctgcagtagttttgactca

SEQ ID NO: 760 - DNA, 20 bp, Artificial Sequence
  Synthetic Oligonucleotide
acggatcacagtggaggaag

SEQ ID NO: 761 - DNA, 20 bp, Artificial Sequence
  Synthetic Oligonucleotide
cgctggctcacccctacctg

SEQ ID NO: 762 - DNA, 20 bp, Artificial Sequence
  Synthetic Oligonucleotide
ctcatccgtcgggtcatagt

SEQ ID NO: 763 - DNA, 20 bp, Artificial Sequence
  Synthetic Oligonucleotide
agttcttgacccctggtcct

SEQ ID NO: 764 - DNA, 20 bp, Artificial Sequence
  Synthetic Oligonucleotide
tctccagcccgtcttggctt

SEQ ID NO: 765 - DNA, 20 bp, Artificial Sequence
  Synthetic Oligonucleotide
aaacggctcaaaggagtcaa

SEQ ID NO: 766 - DNA, 18 bp, Artificial Sequence
  Synthetic Oligonucleotide
acccccagaccggatcag

SEQ ID NO: 767 - DNA, 23 bp, Artificial Sequence
  Synthetic Oligonucleotide
ctggccctcatgtccccttcacg

SEQ ID NO: 768 - DNA, 23 bp, Artificial Sequence
  Synthetic Oligonucleotide
tgtagggcagacttcctcaaaca

SEQ ID NO: 769 - DNA, 19 bp, Artificial Sequence
  Synthetic Oligonucleotide
cgtggtgcccctctatgac

SEQ ID NO: 770 - DNA, 19 bp, Artificial Sequence
  Synthetic Oligonucleotide
ctggagatgctggacgccc

SEQ ID NO: 771 - DNA, 19 bp, Artificial Sequence
  Synthetic Oligonucleotide
ggctagtgggcgcatgtag

SEQ ID NO: 772 - DNA, 18 bp, Artificial Sequence
  Synthetic Oligonucleotide
tccagtgcctatgacccc

SEQ ID NO: 773 - DNA, 24 bp, Artificial Sequence
  Synthetic Oligonucleotide
cagacaaatcgccatcaagtcccc

SEQ ID NO: 774 - DNA, 18 bp, Artificial Sequence
  Synthetic Oligonucleotide
actgtccaagggcaccag

SEQ ID NO: 775 - DNA, 23 bp, Artificial Sequence
  Synthetic Oligonucleotide
gtgaaggatgtgaagcagacgta

SEQ ID NO: 776 - DNA, 21 bp, Artificial Sequence
  Synthetic Oligonucleotide
tggcacgggtcttctcctacc

SEQ ID NO: 777 - DNA, 20 bp, Artificial Sequence
  Synthetic Oligonucleotide
aaccggtgctctccacattc

SEQ ID NO: 778 - DNA, 19 bp, Artificial Sequence
  Synthetic Oligonucleotide
gctttgccaccaggaaagt

SEQ ID NO: 779 - DNA, 24 bp, Artificial Sequence
  Synthetic Oligonucleotide
ctggcatggccaaacctaacatga

SEQ ID NO: 780 - DNA, 20 bp, Artificial Sequence
  Synthetic Oligonucleotide
catccccattcacactgatg

SEQ ID NO: 781 - DNA, 18 bp, Artificial Sequence
  Synthetic Oligonucleotide
ctgaccagaaccacggct

SEQ ID NO: 782 - DNA, 24 bp, Artificial Sequence
  Synthetic Oligonucleotide
cggcctgtccacgaaccacttata

SEQ ID NO: 783 - DNA, 18 bp, Artificial Sequence
  Synthetic Oligonucleotide
ggaagtgggtcatgtggg

SEQ ID NO: 784 - DNA, 21 bp, Artificial Sequence
  Synthetic Oligonucleotide
ggattgctcaacaaccatgct

SEQ ID NO: 785 - DNA, 30 bp, Artificial Sequence
  Synthetic Oligonucleotide
tctggaccctcctacctctggttcttacgt

SEQ ID NO: 786 - DNA, 24 bp, Artificial Sequence
  Synthetic Oligonucleotide
ggcattaacacttttggacgataa

SEQ ID NO: 787 - DNA, 24 bp, Artificial Sequence
  Synthetic Oligonucleotide
gcactttgggattctttccattat

SEQ ID NO: 788 - DNA, 29 bp, Artificial Sequence
  Synthetic Oligonucleotide
acaacattctcggtgcctgtaacaaagaa

SEQ ID NO: 789 - DNA, 24 bp, Artificial Sequence
  Synthetic Oligonucleotide
gcatgtaagaagaccctcactgaa

SEQ ID NO: 790 - DNA, 18 bp, Artificial Sequence
  Synthetic Oligonucleotide
gcctcttcctgttcgacg

SEQ ID NO: 791 - DNA, 24 bp, Artificial Sequence
  Synthetic Oligonucleotide
tcgcccacctacgtactggcctac

SEQ ID NO: 792 - DNA, 18 bp, Artificial Sequence
  Synthetic Oligonucleotide
gctttgcccggtagctct

SEQ ID NO: 793 - DNA, 28 bp, Artificial Sequence
  Synthetic Oligonucleotide
ggctattcctcattttctctacaaagtg

SEQ ID NO: 794 - DNA, 30 bp, Artificial Sequence
  Synthetic Oligonucleotide
cctccaggaggctaccttcttcatgttcac

SEQ ID NO: 795 - DNA, 25 bp, Artificial Sequence
  Synthetic Oligonucleotide
ggattgtagactgtcaccgaaattc

SEQ ID NO: 796 - DNA, 20 bp, Artificial Sequence
  Synthetic Oligonucleotide
ccccagtttcaacgagactt

SEQ ID NO: 797 - DNA, 27 bp, Artificial Sequence
  Synthetic Oligonucleotide
tcattgctccctaaagagttggcactc

SEQ ID NO: 798 - DNA, 20 bp, Artificial Sequence
  Synthetic Oligonucleotide
gttccaggaatgaaagcaca

SEQ ID NO: 799 - DNA, 22 bp, Artificial Sequence
  Synthetic Oligonucleotide
gagatgattcagttaccgggag

SEQ ID NO: 800 - DNA, 24 bp, Artificial Sequence
  Synthetic Oligonucleotide
aatccacaggatccaaaatgggcc

SEQ ID NO: 801 - DNA, 20 bp, Artificial Sequence
  Synthetic Oligonucleotide
atcttgtcctggagacccaa

SEQ ID NO: 802 - DNA, 18 bp, Artificial Sequence
  Synthetic Oligonucleotide
ctctgcaggcctaggtgc

SEQ ID NO: 803 - DNA, 24 bp, Artificial Sequence
  Synthetic Oligonucleotide
ctcctcagcggctccagctcatat

SEQ ID NO: 804 - DNA, 21 bp, Artificial Sequence
  Synthetic Oligonucleotide
ccaggactgtgaagagctgtc

SEQ ID NO: 805 - DNA, 21 bp, Artificial Sequence
  Synthetic Oligonucleotide
cggtagtcaagtccggatcaa

SEQ ID NO: 806 - DNA, 25 bp, Artificial Sequence
  Synthetic Oligonucleotide
caaggagacggaattctacctgtgc

SEQ ID NO: 807 - DNA, 18 bp, Artificial Sequence
  Synthetic Oligonucleotide
gcttgcctttgcggttca

SEQ ID NO: 808 - DNA, 20 bp, Artificial Sequence
  Synthetic Oligonucleotide
agatgcaggagagaggaagc

SEQ ID NO: 809 - DNA, 24 bp, Artificial Sequence
  Synthetic Oligonucleotide
cctgcagactgctttttgcccaat

SEQ ID NO: 810 - DNA, 20 bp, Artificial Sequence
  Synthetic Oligonucleotide
gttttgcagccttacccaat

SEQ ID NO: 811 - DNA, 20 bp, Artificial Sequence
  Synthetic Oligonucleotide
cacgggacattcaccacatc

SEQ ID NO: 812 - DNA, 27 bp, Artificial Sequence
  Synthetic Oligonucleotide
ataaaaagacaaccaacggccgactgc

SEQ ID NO: 813 - DNA, 19 bp, Artificial Sequence
  Synthetic Oligonucleotide
gggtgccatccacttcaca

SEQ ID NO: 814 - DNA, 19 bp, Artificial Sequence
  Synthetic Oligonucleotide
gagggactgttggcatgca

SEQ ID NO: 815 - DNA, 27 bp, Artificial Sequence
  Synthetic Oligonucleotide
tcccagagaccaacgttcaagcagttg

SEQ ID NO: 816 - DNA, 25 bp, Artificial Sequence
  Synthetic Oligonucleotide
gagtgagaattcgatccaagtcttc

SEQ ID NO: 817 - DNA, 18 bp, Artificial Sequence
  Synthetic Oligonucleotide
ccagtggagcgcttccat

SEQ ID NO: 818 - DNA, 23 bp, Artificial Sequence
  Synthetic Oligonucleotide
tcggccacttcatcaggacgcag

SEQ ID NO: 819 - DNA, 22 bp, Artificial Sequence
  Synthetic Oligonucleotide
ctctctgggtcgtctgaaacaa

SEQ ID NO: 820 - DNA, 22 bp, Artificial Sequence
  Synthetic Oligonucleotide
ggttccagctttctgtagctgt

SEQ ID NO: 821 - DNA, 24 bp, Artificial Sequence
  Synthetic Oligonucleotide
attggtggccacaccacctcctta

SEQ ID NO: 822 - DNA, 19 bp, Artificial Sequence
  Synthetic Oligonucleotide
gccgcaggttctagttgct

SEQ ID NO: 823 - DNA, 19 bp, Artificial Sequence
  Synthetic Oligonucleotide
ccaccagcatgaagtttcg

SEQ ID NO: 824 - DNA, 24 bp, Artificial Sequence
  Synthetic Oligonucleotide
acccctcacaaaggccatgtctgt

SEQ ID NO: 825 - DNA, 20 bp, Artificial Sequence
  Synthetic Oligonucleotide
ggctgtctgaagcacaactg

SEQ ID NO: 826 - DNA, 19 bp, Artificial Sequence
  Synthetic Oligonucleotide
gccacacaaacatgctcct

SEQ ID NO: 827 - DNA, 24 bp, Artificial Sequence
  Synthetic Oligonucleotide
atgtctttcccagcagctctgcct

SEQ ID NO: 828 - DNA, 18 bp, Artificial Sequence
  Synthetic Oligonucleotide
gccacaggaaacttccga

SEQ ID NO: 829 - DNA, 20 bp, Artificial Sequence
  Synthetic Oligonucleotide
ggctcccgaatctatctttg

SEQ ID NO: 830 - DNA, 24 bp, Artificial Sequence
  Synthetic Oligonucleotide
ctacagcaccaagagcgacgtgtg

SEQ ID NO: 831 - DNA, 20 bp, Artificial Sequence
  Synthetic Oligonucleotide
tcccacagcaatactccgta

SEQ ID NO: 832 - DNA, 20 bp, Artificial Sequence
  Synthetic Oligonucleotide
accaagaagctgaggacctg

SEQ ID NO: 833 - DNA, 23 bp, Artificial Sequence
  Synthetic Oligonucleotide
agcccgctgaccatggaagatct

SEQ ID NO: 834 - DNA, 20 bp, Artificial Sequence
  Synthetic Oligonucleotide
cctggaagctgtagcagaca

SEQ ID NO: 835 - DNA, 21 bp, Artificial Sequence
  Synthetic Oligonucleotide
cgagccctttgatgacttcct

SEQ ID NO: 836 - DNA, 22 bp, Artificial Sequence
  Synthetic Oligonucleotide
tcccagcatcatccaggcccag

SEQ ID NO: 837 - DNA, 18 bp, Artificial Sequence
  Synthetic Oligonucleotide
ggagcgggctgtctcaga

SEQ ID NO: 838 - DNA, 20 bp, Artificial Sequence
  Synthetic Oligonucleotide
tgaagtccaggacgatgatg

SEQ ID NO: 839 - DNA, 24 bp, Artificial Sequence
  Synthetic Oligonucleotide
ctctacagcagctcagccagcctg

SEQ ID NO: 840 - DNA, 20 bp, Artificial Sequence
  Synthetic Oligonucleotide
acggcttgcttactgaaggt

SEQ ID NO: 841 - DNA, 18 bp, Artificial Sequence
  Synthetic Oligonucleotide
cagccctgccagtttgac

SEQ ID NO: 842 - DNA, 24 bp, Artificial Sequence
  Synthetic Oligonucleotide
atgccgtcttctgccctaacctga

SEQ ID NO: 843 - DNA, 19 bp, Artificial Sequence
  Synthetic Oligonucleotide
gttgcctgtggatgacacc

SEQ ID NO: 844 - DNA, 20 bp, Artificial Sequence
  Synthetic Oligonucleotide
ttggtacctgtgggttagca

SEQ ID NO: 845 - DNA, 26 bp, Artificial Sequence
  Synthetic Oligonucleotide
tccccagggtagaattcaatcagagc

SEQ ID NO: 846 - DNA, 20 bp, Artificial Sequence
  Synthetic Oligonucleotide
cacatccaaatgcaaactgg

SEQ ID NO: 847 - DNA, 23 bp, Artificial Sequence
  Synthetic Oligonucleotide
gtaagtcggatgagcctgtctgt

SEQ ID NO: 848 - DNA, 26 bp, Artificial Sequence
  Synthetic Oligonucleotide
ccagtgacaatgccacttatgccagc

SEQ ID NO: 849 - DNA, 21 bp, Artificial Sequence
  Synthetic Oligonucleotide
cagcttccttcatggcacact

SEQ ID NO: 850 - DNA, 24 bp, Artificial Sequence
  Synthetic Oligonucleotide
aagtcctcgatacgcactatagca

SEQ ID NO: 851 - DNA, 21 bp, Artificial Sequence
  Synthetic Oligonucleotide
cccggatggtctccacgtcat

SEQ ID NO: 852 - DNA, 19 bp, Artificial Sequence
  Synthetic Oligonucleotide
ctggcatgtggcacatgag

SEQ ID NO: 853 - DNA, 26 bp, Artificial Sequence
  Synthetic Oligonucleotide
ggataattcagacaacaacaccatct

SEQ ID NO: 854 - DNA, 29 bp, Artificial Sequence
  Synthetic Oligonucleotide
tcaattgtaacattctcacccaggccttg

SEQ ID NO: 855 - DNA, 25 bp, Artificial Sequence
  Synthetic Oligonucleotide
tgaagtaatcagccacagactcaat

SEQ ID NO: 856 - DNA, 19 bp, Artificial Sequence
  Synthetic Oligonucleotide
ccgtgctcattgctaacca

SEQ ID NO: 857 - DNA, 24 bp, Artificial Sequence
  Synthetic Oligonucleotide
tctgtccctgaactcccagaacca

SEQ ID NO: 858 - DNA, 19 bp, Artificial Sequence
  Synthetic Oligonucleotide
ctgcccaaagccagatgta

SEQ ID NO: 859 - DNA, 20 bp, Artificial Sequence
  Synthetic Oligonucleotide
cagttcggtccaacagagaa

SEQ ID NO: 860 - DNA, 24 bp, Artificial Sequence
  Synthetic Oligonucleotide
agcaggcaaccaccatgtcatttg

SEQ ID NO: 861 - DNA, 20 bp, Artificial Sequence
  Synthetic Oligonucleotide
tgcgaattatatcccgatga

SEQ ID NO: 862 - DNA, 20 bp, Artificial Sequence
  Synthetic Oligonucleotide
cgtgtgtctcaagacgatcc

SEQ ID NO: 863 - DNA, 24 bp, Artificial Sequence
  Synthetic Oligonucleotide
tgtgtaccctaatgggtcccgctt

SEQ ID NO: 864 - DNA, 18 bp, Artificial Sequence
  Synthetic Oligonucleotide
ggtccctgtgctgtctgg

SEQ ID NO: 865 - DNA, 20 bp, Artificial Sequence
  Synthetic Oligonucleotide
agagcaccaaagcagctcat

SEQ ID NO: 866 - DNA, 24 bp, Artificial Sequence
  Synthetic Oligonucleotide
cactgatgacaccacgacgctctc

SEQ ID NO: 867 - DNA, 19 bp, Artificial Sequence
  Synthetic Oligonucleotide
gtgcttggggatggtctct

SEQ ID NO: 868 - DNA, 20 bp, Artificial Sequence
  Synthetic Oligonucleotide
gaagcgcagatcatgaagaa

SEQ ID NO: 869 - DNA, 24 bp, Artificial Sequence
  Synthetic Oligonucleotide
ctgaagcacgacaagctggtccag

SEQ ID NO: 870 - DNA, 20 bp, Artificial Sequence
  Synthetic Oligonucleotide
ctcctcagacaccactgcat

SEQ ID NO: 871 - DNA, 20 bp, Artificial Sequence
  Synthetic Oligonucleotide
ggtgcaccagttctaccctc

SEQ ID NO: 872 - DNA, 24 bp, Artificial Sequence
  Synthetic Oligonucleotide
acttgagctcagcggaacactgca

SEQ ID NO: 873 - DNA, 19 bp, Artificial Sequence
  Synthetic Oligonucleotide
gcgtacatggagcacagga

SEQ ID NO: 874 - DNA, 18 bp, Artificial Sequence
  Synthetic Oligonucleotide
tggatcctcacctggtcg

SEQ ID NO: 875 - DNA, 24 bp, Artificial Sequence
  Synthetic Oligonucleotide
tgcgcttccaccttcttcactgtc

SEQ ID NO: 876 - DNA, 18 bp, Artificial Sequence
  Synthetic Oligonucleotide
gcgctgcatgtctaccaa

SEQ ID NO: 877 - DNA, 20 bp, Artificial Sequence
  Synthetic Oligonucleotide
aatgagagaggtgaaagcgg

SEQ ID NO: 878 - DNA, 24 bp, Artificial Sequence
  Synthetic Oligonucleotide
cggagctagcacccccaggttaag

SEQ ID NO: 879 - DNA, 21 bp, Artificial Sequence
  Synthetic Oligonucleotide
aggttcaccacagtcctgttc

SEQ ID NO: 880 - DNA, 19 bp, Artificial Sequence
  Synthetic Oligonucleotide
tcagcagcaagggcatcat

SEQ ID NO: 881 - DNA, 19 bp, Artificial Sequence
  Synthetic Oligonucleotide
cgcccgcaggcctcatcct

SEQ ID NO: 882 - DNA, 23 bp, Artificial Sequence
  Synthetic Oligonucleotide
ggtggttttcttgagcgtgtact

SEQ ID NO: 883 - DNA, 19 bp, Artificial Sequence
  Synthetic Oligonucleotide
caacgaattccaggtgtcc

SEQ ID NO: 884 - DNA, 23 bp, Artificial Sequence
  Synthetic Oligonucleotide
ctgagcagctccatgtcggtgtc

SEQ ID NO: 885 - DNA, 18 bp, Artificial Sequence
  Synthetic Oligonucleotide
gatctgcgccttcagctc

SEQ ID NO: 886 - DNA, 18 bp, Artificial Sequence
  Synthetic Oligonucleotide
gtgctggtgacgaatcca

SEQ ID NO: 887 - DNA, 25 bp, Artificial Sequence
  Synthetic Oligonucleotide
ttcatctcaatggaaggatcctgcc

SEQ ID NO: 888 - DNA, 20 bp, Artificial Sequence
  Synthetic Oligonucleotide
cccggcaaaaacaaataagt

SEQ ID NO: 889 - DNA, 20 bp, Artificial Sequence
  Synthetic Oligonucleotide
accctcgacaagaccacact

SEQ ID NO: 890 - DNA, 24 bp, Artificial Sequence
  Synthetic Oligonucleotide
aacttcagccccagctcccaagtc

SEQ ID NO: 891 - DNA, 20 bp, Artificial Sequence
  Synthetic Oligonucleotide
tgggagttcatgggtacaga

SEQ ID NO: 892 - DNA, 18 bp, Artificial Sequence
  Synthetic Oligonucleotide
cgcgctgcagatccattt

SEQ ID NO: 893 - DNA, 23 bp, Artificial Sequence
  Synthetic Oligonucleotide
cgctgatccaggctttctgctgc

SEQ ID NO: 894 - DNA, 22 bp, Artificial Sequence
  Synthetic Oligonucleotide
cgcactatgtcgatgtcgttct

SEQ ID NO: 895 - DNA, 20 bp, Artificial Sequence
  Synthetic Oligonucleotide
ggaacagggtcacccacaga

SEQ ID NO: 896 - DNA, 27 bp, Artificial Sequence
  Synthetic Oligonucleotide
tcaggaccatcttcacactcacaccca

SEQ ID NO: 897 - DNA, 19 bp, Artificial Sequence
  Synthetic Oligonucleotide
gatttggcgggtccatctc

SEQ ID NO: 898 - DNA, 20 bp, Artificial Sequence
  Synthetic Oligonucleotide
ttgggaaatatttgggcatt

SEQ ID NO: 899 - DNA, 26 bp, Artificial Sequence
  Synthetic Oligonucleotide
ttgggacattgtagacttggccagac

SEQ ID NO: 900 - DNA, 20 bp, Artificial Sequence
  Synthetic Oligonucleotide
agaagctagggtggttgtcc

SEQ ID NO: 901 - DNA, 19 bp, Artificial Sequence
  Synthetic Oligonucleotide
gcatgggaaccatcaacca

SEQ ID NO: 902 - DNA, 30 bp, Artificial Sequence
  Synthetic Oligonucleotide
ccatggaccaacttcactatgtgacagagc

SEQ ID NO: 903 - DNA, 21 bp, Artificial Sequence
  Synthetic Oligonucleotide
tgaggagtttgccttgattcg

SEQ ID NO: 904 - DNA, 20 bp, Artificial Sequence
  Synthetic Oligonucleotide
ctgttgcaggaaggcattga

SEQ ID NO: 905 - DNA, 21 bp, Artificial Sequence
  Synthetic Oligonucleotide
catctcctggcccagcatgtt

SEQ ID NO: 906 - DNA, 28 bp, Artificial Sequence
  Synthetic Oligonucleotide
gtcagtgggtctctaataaagagatgag

SEQ ID NO: 907 - DNA, 30 bp, Artificial Sequence
  Synthetic Oligonucleotide
tgtagaatcaaactcttcatcatcaactag

SEQ ID NO: 908 - DNA, 26 bp, Artificial Sequence
  Synthetic Oligonucleotide
tgcagttgacatggcctgttcagtcc

SEQ ID NO: 909 - DNA, 22 bp, Artificial Sequence
  Synthetic Oligonucleotide
cacagaatccagctgtgcaact

SEQ ID NO: 910 - DNA, 20 bp, Artificial Sequence
  Synthetic Oligonucleotide
tggtgcttggagcatagaag

SEQ ID NO: 911 - DNA, 24 bp, Artificial Sequence
  Synthetic Oligonucleotide
tgcccttcacaaaggaaatccctg

SEQ ID NO: 912 - DNA, 19 bp, Artificial Sequence
  Synthetic Oligonucleotide
gcaacgtcctcagcatttc

SEQ ID NO: 913 - DNA, 21 bp, Artificial Sequence
  Synthetic Oligonucleotide
cgctccagacctatgatgact

SEQ ID NO: 914 - DNA, 24 bp, Artificial Sequence
  Synthetic Oligonucleotide
tgttagccaaagactgccactgca

SEQ ID NO: 915 - DNA, 20 bp, Artificial Sequence
  Synthetic Oligonucleotide
acagtggaaggaccaggact

SEQ ID NO: 916 - DNA, 20 bp, Artificial Sequence
  Synthetic Oligonucleotide
gtgtatgacgaggtggatcg

SEQ ID NO: 917 - DNA, 24 bp, Artificial Sequence
  Synthetic Oligonucleotide
agccagccacactgcatcattttc

SEQ ID NO: 918 - DNA, 20 bp, Artificial Sequence
  Synthetic Oligonucleotide
accagagtgctgtggttttg

SEQ ID NO: 919 - DNA, 19 bp, Artificial Sequence
  Synthetic Oligonucleotide
gttcactgggggtgtatgg

SEQ ID NO: 920 - DNA, 24 bp, Artificial Sequence
  Synthetic Oligonucleotide
atcccctccctctccacccatcta

SEQ ID NO: 921 - DNA, 23 bp, Artificial Sequence
  Synthetic Oligonucleotide
aaataccaacatgcacctctctt

SEQ ID NO: 922 - DNA, 20 bp, Artificial Sequence
  Synthetic Oligonucleotide
tgtcatgtacgacggcttct

SEQ ID NO: 923 - DNA, 21 bp, Artificial Sequence
  Synthetic Oligonucleotide
aggcgttgcacttcaccagcc

SEQ ID NO: 924 - DNA, 20 bp, Artificial Sequence
  Synthetic Oligonucleotide
agtccacagtgttgggacaa

SEQ ID NO: 925 - DNA, 18 bp, Artificial Sequence
  Synthetic Oligonucleotide
gcttatgaccgaccccaa

SEQ ID NO: 926 - DNA, 24 bp, Artificial Sequence
  Synthetic Oligonucleotide
ctcatcacctggtctccggtgtgt

SEQ ID NO: 927 - DNA, 20 bp, Artificial Sequence
  Synthetic Oligonucleotide
aaagttccaggcaacatcgt

SEQ ID NO: 928 - DNA, 24 bp, Artificial Sequence
  Synthetic Oligonucleotide
cacacagatctcctactccatcca

SEQ ID NO: 929 - DNA, 26 bp, Artificial Sequence
  Synthetic Oligonucleotide
catgctgcatcctaaggctcctcagg

SEQ ID NO: 930 - DNA, 21 bp, Artificial Sequence
  Synthetic Oligonucleotide
ggtccagcagtgtctcctgaa

SEQ ID NO: 931 - DNA, 19 bp, Artificial Sequence
  Synthetic Oligonucleotide
cttcgcctttgctgattgc

SEQ ID NO: 932 - DNA, 24 bp, Artificial Sequence
  Synthetic Oligonucleotide
ctccaaacgcctgcctgacgactg

SEQ ID NO: 933 - DNA, 20 bp, Artificial Sequence
  Synthetic Oligonucleotide
ccataacgcacatgctccaa

SEQ ID NO: 934 - DNA, 20 bp, Artificial Sequence
  Synthetic Oligonucleotide
tcccactgaagccctttcag

SEQ ID NO: 935 - DNA, 26 bp, Artificial Sequence
  Synthetic Oligonucleotide
cctccaagcgagtccttcttcaaccg

SEQ ID NO: 936 - DNA, 20 bp, Artificial Sequence
  Synthetic Oligonucleotide
agtgcccaggcgtaaacatc

SEQ ID NO: 937 - DNA, 20 bp, Artificial Sequence
  Synthetic Oligonucleotide
gtccatcagtgcatgacgtt

SEQ ID NO: 938 - DNA, 26 bp, Artificial Sequence
  Synthetic Oligonucleotide
aggccacgtatagtcctagctgacgc

SEQ ID NO: 939 - DNA, 20 bp, Artificial Sequence
  Synthetic Oligonucleotide
agcccacttggtttcttgtt

SEQ ID NO: 940 - DNA, 20 bp, Artificial Sequence
  Synthetic Oligonucleotide
ccatctgcatccatcttgtt

SEQ ID NO: 941 - DNA, 23 bp, Artificial Sequence
  Synthetic Oligonucleotide
ctccccacccttgagaagtgcct

SEQ ID NO: 942 - DNA, 20 bp, Artificial Sequence
  Synthetic Oligonucleotide
ggccaccagggtattatctg

SEQ ID NO: 943 - DNA, 18 bp, Artificial Sequence
  Synthetic Oligonucleotide
gttgggtgcatctctcgg

SEQ ID NO: 944 - DNA, 24 bp, Artificial Sequence
  Synthetic Oligonucleotide
aattcatgccgagatacagccgct

SEQ ID NO: 945 - DNA, 21 bp, Artificial Sequence
  Synthetic Oligonucleotide
cgtgctccatcttcctagctt

SEQ ID NO: 946 - DNA, 23 bp, Artificial Sequence
  Synthetic Oligonucleotide
cgaaaagatgctgaacagtgaca

SEQ ID NO: 947 - DNA, 28 bp, Artificial Sequence
  Synthetic Oligonucleotide
cttcctcctcccttctggtcagttggat

SEQ ID NO: 948 - DNA, 20 bp, Artificial Sequence
  Synthetic Oligonucleotide
tcaggaacagccaccagtga

SEQ ID NO: 949 - DNA, 23 bp, Artificial Sequence
  Synthetic Oligonucleotide
ctgggtctcatagaagcaaagga

SEQ ID NO: 950 - DNA, 25 bp, Artificial Sequence
  Synthetic Oligonucleotide
agaaaccaccagccacctcaaccca

SEQ ID NO: 951 - DNA, 19 bp, Artificial Sequence
  Synthetic Oligonucleotide
ccacgaaggctgctgattg

SEQ ID NO: 952 - DNA, 18 bp, Artificial Sequence
  Synthetic Oligonucleotide
atgctgctggccattcca

SEQ ID NO: 953 - DNA, 27 bp, Artificial Sequence
  Synthetic Oligonucleotide
ccgtgttttctgacctccatcccttcc

SEQ ID NO: 954 - DNA, 21 bp, Artificial Sequence
  Synthetic Oligonucleotide
aggtctggttggtgctttcct

SEQ ID NO: 955 - DNA, 18 bp, Artificial Sequence
  Synthetic Oligonucleotide
gacaaggacggcagcaag

SEQ ID NO: 956 - DNA, 24 bp, Artificial Sequence
  Synthetic Oligonucleotide
ccaggagttgccaccactgttgtc

SEQ ID NO: 957 - DNA, 18 bp, Artificial Sequence
  Synthetic Oligonucleotide
ttgtggcctgtctggacc

SEQ ID NO: 958 - DNA, 20 bp, Artificial Sequence
  Synthetic Oligonucleotide
tctccaacttccctctgctg

SEQ ID NO: 959 - DNA, 24 bp, Artificial Sequence
  Synthetic Oligonucleotide
aggccctgaaaaccagaatcagca

SEQ ID NO: 960 - DNA, 18 bp, Artificial Sequence
  Synthetic Oligonucleotide
acttcttcaccgtgggca

SEQ ID NO: 961 - DNA, 27 bp, Artificial Sequence
  Synthetic Oligonucleotide
aagctatgaggaaaagaagtacacgat

SEQ ID NO: 962 - DNA, 30 bp, Artificial Sequence
  Synthetic Oligonucleotide
tcagccactggcttctgtcataatcaggag

SEQ ID NO: 963 - DNA, 20 bp, Artificial Sequence
  Synthetic Oligonucleotide
ggcccagcttgaatttttca

SEQ ID NO: 964 - DNA, 21 bp, Artificial Sequence
  Synthetic Oligonucleotide
caatgccatcttgcgctacat

SEQ ID NO: 965 - DNA, 27 bp, Artificial Sequence
  Synthetic Oligonucleotide
ctcgcaagcacaacatgtgtggtgaga

SEQ ID NO: 966 - DNA, 25 bp, Artificial Sequence
  Synthetic Oligonucleotide
gtccactcgaatcttttcttcttca

SEQ ID NO: 967 - DNA, 20 bp, Artificial Sequence
  Synthetic Oligonucleotide
gagaccctgctgtcccagaa

SEQ ID NO: 968 - DNA, 26 bp, Artificial Sequence
  Synthetic Oligonucleotide
tcccacaatgaaggtcttgcctccct

SEQ ID NO: 969 - DNA, 23 bp, Artificial Sequence
  Synthetic Oligonucleotide
ggttgtagtcagcgaaggagatc

SEQ ID NO: 970 - DNA, 19 bp, Artificial Sequence
  Synthetic Oligonucleotide
caccatccccaccctgtct

SEQ ID NO: 971 - DNA, 23 bp, Artificial Sequence
  Synthetic Oligonucleotide
cacagccgcctgaaagccacaat

SEQ ID NO: 972 - DNA, 21 bp, Artificial Sequence
  Synthetic Oligonucleotide
ggcctcagtgtgcatcattct

SEQ ID NO: 973 - DNA, 18 bp, Artificial Sequence
  Synthetic Oligonucleotide
ccggaaaggccaagacaa

SEQ ID NO: 974 - DNA, 19 bp, Artificial Sequence
  Synthetic Oligonucleotide
cccgctcgcagagagccgg

SEQ ID NO: 975 - DNA, 20 bp, Artificial Sequence
  Synthetic Oligonucleotide
aatacggcccactgggaact

SEQ ID NO: 976 - DNA, 20 bp, Artificial Sequence
  Synthetic Oligonucleotide
gactccttcgtccccagttg

SEQ ID NO: 977 - DNA, 25 bp, Artificial Sequence
  Synthetic Oligonucleotide
ttgggcctcccataattgctttgcc

SEQ ID NO: 978 - DNA, 21 bp, Artificial Sequence
  Synthetic Oligonucleotide
tggcacttgaaggctctggta

SEQ ID NO: 979 - DNA, 23 bp, Artificial Sequence
  Synthetic Oligonucleotide
tgacacccttaccttcctgagaa

SEQ ID NO: 980 - DNA, 21 bp, Artificial Sequence
  Synthetic Oligonucleotide
tctgctttccgcgctcccagg

SEQ ID NO: 981 - DNA, 29 bp, Artificial Sequence
  Synthetic Oligonucleotide
aaaaacacgagtcaaaaatagaagtcact

SEQ ID NO: 982 - DNA, 27 bp, Artificial Sequence
  Synthetic Oligonucleotide
caagtaccacagcgatgactacattaa

SEQ ID NO: 983 - DNA, 23 bp, Artificial Sequence
  Synthetic Oligonucleotide
ttcttgcgctccatccgtccaga

SEQ ID NO: 984 - DNA, 22 bp, Artificial Sequence
  Synthetic Oligonucleotide
gcttgctgtactccgacatgtt

SEQ ID NO: 985 - DNA, 20 bp, Artificial Sequence
  Synthetic Oligonucleotide
ggtggctacacaatccgtaa

SEQ ID NO: 986 - DNA, 27 bp, Artificial Sequence
  Synthetic Oligonucleotide
tgcagtctcatatgtccaacatcgagc

SEQ ID NO: 987 - DNA, 20 bp, Artificial Sequence
  Synthetic Oligonucleotide
tgggaatctcacaatcaagg

SEQ ID NO: 988 - DNA, 20 bp, Artificial Sequence
  Synthetic Oligonucleotide
tcctaggcattctggacctc

SEQ ID NO: 989 - DNA, 24 bp, Artificial Sequence
  Synthetic Oligonucleotide
cattcctacccctgatcccaaccc

SEQ ID NO: 990 - DNA, 20 bp, Artificial Sequence
  Synthetic Oligonucleotide
gctgttgatgctccatcctt

SEQ ID NO: 991 - DNA, 19 bp, Artificial Sequence
  Synthetic Oligonucleotide
agccgtgactgttgaggtc

SEQ ID NO: 992 - DNA, 21 bp, Artificial Sequence
  Synthetic Oligonucleotide
aagtccagcatcgcaggcagc

SEQ ID NO: 993 - DNA, 20 bp, Artificial Sequence
  Synthetic Oligonucleotide
aagtaacgttcccaggtgct

SEQ ID NO: 994 - DNA, 20 bp, Artificial Sequence
  Synthetic Oligonucleotide
aggctgctggaggtcatctc

SEQ ID NO: 995 - DNA, 21 bp, Artificial Sequence
  Synthetic Oligonucleotide
ccagaggccgtttcttggccg

SEQ ID NO: 996 - DNA, 19 bp, Artificial Sequence
  Synthetic Oligonucleotide
cttcctgcggccacagtct

SEQ ID NO: 997 - DNA, 20 bp, Artificial Sequence
  Synthetic Oligonucleotide
cggtgtgagaagtgcagcaa

SEQ ID NO: 998 - DNA, 24 bp, Artificial Sequence
  Synthetic Oligonucleotide
ccagaccatagcacactcgggcac

SEQ ID NO: 999 - DNA, 19 bp, Artificial Sequence
  Synthetic Oligonucleotide
cctctcgcaagtgctccat

SEQ ID NO: 1000 - DNA, 20 bp, Artificial Sequence
  Synthetic Oligonucleotide
caccctgtcctatccttcct

SEQ ID NO: 1001 - DNA, 25 bp, Artificial Sequence
  Synthetic Oligonucleotide
ccctcttgggacctagtctctgcct

SEQ ID NO: 1002 - DNA, 20 bp, Artificial Sequence
  Synthetic Oligonucleotide
ggccaggggtagagagtaga

SEQ ID NO: 1003 - DNA, 19 bp, Artificial Sequence
  Synthetic Oligonucleotide
ttagggaccctgcagctct

SEQ ID NO: 1004 - DNA, 23 bp, Artificial Sequence
  Synthetic Oligonucleotide
tagctccctccctccacccactc

SEQ ID NO: 1005 - DNA, 22 bp, Artificial Sequence
  Synthetic Oligonucleotide
ctacaaaattcttcctcctgcc

SEQ ID NO: 1006 - DNA, 20 bp, Artificial Sequence
  Synthetic Oligonucleotide
ccgaaatccagatgatgatg

SEQ ID NO: 1007 - DNA, 23 bp, Artificial Sequence
  Synthetic Oligonucleotide
ctcatggaccctggtgctacacg

SEQ ID NO: 1008 - DNA, 20 bp, Artificial Sequence
  Synthetic Oligonucleotide
cccaaggaatgagtggattt

SEQ ID NO: 1009 - DNA, 24 bp, Artificial Sequence
  Synthetic Oligonucleotide
tgaacataaagtctgcaacatgga

SEQ ID NO: 1010 - DNA, 24 bp, Artificial Sequence
  Synthetic Oligonucleotide
ttgcactgcacaggccacattcac

SEQ ID NO: 1011 - DNA, 28 bp, Artificial Sequence
  Synthetic Oligonucleotide
tgaggttggttactgttggtatcatata

SEQ ID NO: 1012 - DNA, 18 bp, Artificial Sequence
  Synthetic Oligonucleotide
tacgcacagaggcaagca

SEQ ID NO: 1013 - DNA, 24 bp, Artificial Sequence
  Synthetic Oligonucleotide
taagagtccgggatccccagccta

SEQ ID NO: 1014 - DNA, 20 bp, Artificial Sequence
  Synthetic Oligonucleotide
gagagaagtgctggagaggc

SEQ ID NO: 1015 - DNA, 21 bp, Artificial Sequence
  Synthetic Oligonucleotide
tccatgatggttctgcaggtt

SEQ ID NO: 1016 - DNA, 21 bp, Artificial Sequence
  Synthetic Oligonucleotide
ccccggacagtggctctgacg

SEQ ID NO: 1017 - DNA, 21 bp, Artificial Sequence
  Synthetic Oligonucleotide
tgagcagcaccatcagtaacg

SEQ ID NO: 1018 - DNA, 20 bp, Artificial Sequence
  Synthetic Oligonucleotide
gacgatttgccagctttgag

SEQ ID NO: 1019 - DNA, 24 bp, Artificial Sequence
  Synthetic Oligonucleotide
tcaaggtgcattggccaacatagc

SEQ ID NO: 1020 - DNA, 18 bp, Artificial Sequence
  Synthetic Oligonucleotide
tccaggttggctttgtcc

SEQ ID NO: 1021 - DNA, 20 bp, Artificial Sequence
  Synthetic Oligonucleotide
gctttctcaggacctggttg

SEQ ID NO: 1022 - DNA, 24 bp, Artificial Sequence
  Synthetic Oligonucleotide
cattttctgcagttgccgaaccag

SEQ ID NO: 1023 - DNA, 18 bp, Artificial Sequence
  Synthetic Oligonucleotide
aggaagccacaagggagg

SEQ ID NO: 1024 - DNA, 19 bp, Artificial Sequence
  Synthetic Oligonucleotide
cctgcgcggctactacaac

SEQ ID NO: 1025 - DNA, 25 bp, Artificial Sequence
  Synthetic Oligonucleotide
cgaggccagttctcacaccctccag

SEQ ID NO: 1026 - DNA, 19 bp, Artificial Sequence
  Synthetic Oligonucleotide
caggtcgcagccaatcatc

SEQ ID NO: 1027 - DNA, 19 bp, Artificial Sequence
  Synthetic Oligonucleotide
tggcctgtccattggtgat

SEQ ID NO: 1028 - DNA, 28 bp, Artificial Sequence
  Synthetic Oligonucleotide
ttccacatctctcccagtttcttcgcaa

SEQ ID NO: 1029 - DNA, 22 bp, Artificial Sequence
  Synthetic Oligonucleotide
gcttgtcatctgcagcagtgtt

SEQ ID NO: 1030 - DNA, 20 bp, Artificial Sequence
  Synthetic Oligonucleotide
ctacttccagcaaccccaga

SEQ ID NO: 1031 - DNA, 20 bp, Artificial Sequence
  Synthetic Oligonucleotide
tccacatcagaatcttcccg

SEQ ID NO: 1032 - DNA, 20 bp, Artificial Sequence
  Synthetic Oligonucleotide
ctttcgggaatcatcttcca

SEQ ID NO: 1033 - DNA, 19 bp, Artificial Sequence
  Synthetic Oligonucleotide
caagggagcgaccaactga

SEQ ID NO: 1034 - DNA, 28 bp, Artificial Sequence
  Synthetic Oligonucleotide
ctccatatccaaacaaagcatgtgtgcg

SEQ ID NO: 1035 - DNA, 28 bp, Artificial Sequence
  Synthetic Oligonucleotide
gtttgccaagttaaatttggtacataat

SEQ ID NO: 1036 - DNA, 20 bp, Artificial Sequence
  Synthetic Oligonucleotide
gccagtaagaacgaggagga

SEQ ID NO: 1037 - DNA, 24 bp, Artificial Sequence
  Synthetic Oligonucleotide
aaggccattcaaactcctccccac

SEQ ID NO: 1038 - DNA, 19 bp, Artificial Sequence
  Synthetic Oligonucleotide
cgtcgctgcttcagagtgt

SEQ ID NO: 1039 - DNA, 23 bp, Artificial Sequence
  Synthetic Oligonucleotide
agtgacagatggacaatgcaaga

SEQ ID NO: 1040 - DNA, 24 bp, Artificial Sequence
  Synthetic Oligonucleotide
tgaactccttcctggaatacccca

SEQ ID NO: 1041 - DNA, 20 bp, Artificial Sequence
  Synthetic Oligonucleotide
ccgagtcgccactgctaagt

SEQ ID NO: 1042 - DNA, 22 bp, Artificial Sequence
  Synthetic Oligonucleotide
tcccttgtgttccttctgtgaa

SEQ ID NO: 1043 - DNA, 28 bp, Artificial Sequence
  Synthetic Oligonucleotide
agccctgttctcgttgccctaattcatc

SEQ ID NO: 1044 - DNA, 24 bp, Artificial Sequence
  Synthetic Oligonucleotide
ggcaataaacaggctcatgattaa

SEQ ID NO: 1045 - DNA, 21 bp, Artificial Sequence
  Synthetic Oligonucleotide
cgtgccttatggttactttgg

SEQ ID NO: 1046 - DNA, 24 bp, Artificial Sequence
  Synthetic Oligonucleotide
acactcggcaggagtagtacccgc

SEQ ID NO: 1047 - DNA, 18 bp, Artificial Sequence
  Synthetic Oligonucleotide
cacagggtttcagcgagc

SEQ ID NO: 1048 - DNA, 20 bp, Artificial Sequence
  Synthetic Oligonucleotide
cagcctcaagttcggttttc

SEQ ID NO: 1049 - DNA, 24 bp, Artificial Sequence
  Synthetic Oligonucleotide
accggagccttcccagaacaaact

SEQ ID NO: 1050 - DNA, 18 bp, Artificial Sequence
  Synthetic Oligonucleotide
gttggaagcaaacgcaca

SEQ ID NO: 1051 - DNA, 19 bp, Artificial Sequence
  Synthetic Oligonucleotide
ggacgaatacgaccccact

SEQ ID NO: 1052 - DNA, 24 bp, Artificial Sequence
  Synthetic Oligonucleotide
accacctgcttccggtaggaatcc

SEQ ID NO: 1053 - DNA, 18 bp, Artificial Sequence
  Synthetic Oligonucleotide
gcacgtctccccatcaat

SEQ ID NO: 1054 - DNA, 19 bp, Artificial Sequence
  Synthetic Oligonucleotide
ggagatggccgagactgac

SEQ ID NO: 1055 - DNA, 23 bp, Artificial Sequence
  Synthetic Oligonucleotide
caagaccgtgcaggacctcacct

SEQ ID NO: 1056 - DNA, 19 bp, Artificial Sequence
  Synthetic Oligonucleotide
ctgcaggagtgtctgcacc

SEQ ID NO: 1057 - DNA, 18 bp, Artificial Sequence
  Synthetic Oligonucleotide
ctggaccgcacggacatc

SEQ ID NO: 1058 - DNA, 25 bp, Artificial Sequence
  Synthetic Oligonucleotide
accgcttctaccaatacctcgccca

SEQ ID NO: 1059 - DNA, 18 bp, Artificial Sequence
  Synthetic Oligonucleotide
cgcctcgcgaaagacttg

SEQ ID NO: 1060 - DNA, 20 bp, Artificial Sequence
  Synthetic Oligonucleotide
gctttccaagtggggaatta

SEQ ID NO: 1061 - DNA, 24 bp, Artificial Sequence
  Synthetic Oligonucleotide
agttgcttccatccaacctggagg

SEQ ID NO: 1062 - DNA, 20 bp, Artificial Sequence
  Synthetic Oligonucleotide
tgcctgcgatatttgttagg

SEQ ID NO: 1063 - DNA, 19 bp, Artificial Sequence
  Synthetic Oligonucleotide
ctgctgcgacagtccacta

SEQ ID NO: 1064 - DNA, 24 bp, Artificial Sequence
  Synthetic Oligonucleotide
agagtgactcccgttgtcccaagg

SEQ ID NO: 1065 - DNA, 18 bp, Artificial Sequence
  Synthetic Oligonucleotide
caggttcgctctgggaag

SEQ ID NO: 1066 - DNA, 19 bp, Artificial Sequence
  Synthetic Oligonucleotide
ggtccgcttcgtctttcga

SEQ ID NO: 1067 - DNA, 20 bp, Artificial Sequence
  Synthetic Oligonucleotide
tgactcccgcggtcccaagg

SEQ ID NO: 1068 - DNA, 19 bp, Artificial Sequence
  Synthetic Oligonucleotide
gcacaggttcgctctggaa

SEQ ID NO: 1069 - DNA, 20 bp, Artificial Sequence
  Synthetic Oligonucleotide
ttcagtgtgtccagtgcatc

SEQ ID NO: 1070 - DNA, 29 bp, Artificial Sequence
  Synthetic Oligonucleotide
cattttcctcagacttgtgaacctccact

SEQ ID NO: 1071 - DNA, 20 bp, Artificial Sequence
  Synthetic Oligonucleotide
atctgtttccattggctcct

SEQ ID NO: 1072 - DNA, 24 bp, Artificial Sequence
  Synthetic Oligonucleotide
ggctagtagaactggatcccaaca

SEQ ID NO: 1073 - DNA, 30 bp, Artificial Sequence
  Synthetic Oligonucleotide
taattagacctaggcctcagctgcactgcc

SEQ ID NO: 1074 - DNA, 20 bp, Artificial Sequence
  Synthetic Oligonucleotide
ggtctgcccaaatgcttttc

SEQ ID NO: 1075 - DNA, 19 bp, Artificial Sequence
  Synthetic Oligonucleotide
cctccctctggtggtgctt

SEQ ID NO: 1076 - DNA, 26 bp, Artificial Sequence
  Synthetic Oligonucleotide
ctcagggcccaccattgaagaggttg

SEQ ID NO: 1077 - DNA, 26 bp, Artificial Sequence
  Synthetic Oligonucleotide
gctacatctacacttggttggcttaa

SEQ ID NO: 1078 - DNA, 19 bp, Artificial Sequence
  Synthetic Oligonucleotide
ccgactggaggagcataaa

SEQ ID NO: 1079 - DNA, 24 bp, Artificial Sequence
  Synthetic Oligonucleotide
cgcacttttctgagcagacgtcca

SEQ ID NO: 1080 - DNA, 19 bp, Artificial Sequence
  Synthetic Oligonucleotide
atgctggctgactctgctc

SEQ ID NO: 1081 - DNA, 20 bp, Artificial Sequence
  Synthetic Oligonucleotide
caaaaggcagaggctgataa

SEQ ID NO: 1082 - DNA, 27 bp, Artificial Sequence
  Synthetic Oligonucleotide
tgaccagatccttcacagacttgtcgt

SEQ ID NO: 1083 - DNA, 20 bp, Artificial Sequence
  Synthetic Oligonucleotide
agcgcagtttcataaagcaa

SEQ ID NO: 1084 - DNA, 20 bp, Artificial Sequence
  Synthetic Oligonucleotide
gcaagcaacagtagtcgctg

SEQ ID NO: 1085 - DNA, 25 bp, Artificial Sequence
  Synthetic Oligonucleotide
tctccaccctttcctttagaacccg

SEQ ID NO: 1086 - DNA, 21 bp, Artificial Sequence
  Synthetic Oligonucleotide
ccaactttcacgctaactggt

SEQ ID NO: 1087 - DNA, 20 bp, Artificial Sequence
  Synthetic Oligonucleotide
gagtacgtgtgccgagtgtt

SEQ ID NO: 1088 - DNA, 23 bp, Artificial Sequence
  Synthetic Oligonucleotide
cagctccgtgcctctagaggcct

SEQ ID NO: 1089 - DNA, 19 bp, Artificial Sequence
  Synthetic Oligonucleotide
ctcaatggtgaccaggaca

SEQ ID NO: 1090 - DNA, 24 bp, Artificial Sequence
  Synthetic Oligonucleotide
gcagacagtgaccatctacagctt

SEQ ID NO: 1091 - DNA, 20 bp, Artificial Sequence
  Synthetic Oligonucleotide
ccggcgcccaacgtgattct

SEQ ID NO: 1092 - DNA, 22 bp, Artificial Sequence
  Synthetic Oligonucleotide
cttctgagacctctggcttcgt

SEQ ID NO: 1093 - DNA, 20 bp, Artificial Sequence
  Synthetic Oligonucleotide
ggtcatcctgacactgcaac

SEQ ID NO: 1094 - DNA, 21 bp, Artificial Sequence
  Synthetic Oligonucleotide
ttgcccacagccaccaaagtg

SEQ ID NO: 1095 - DNA, 20 bp, Artificial Sequence
  Synthetic Oligonucleotide
tgcactcaatggtgaaggac

SEQ ID NO: 1096 - DNA, 19 bp, Artificial Sequence
  Synthetic Oligonucleotide
agaaccgcaaggtgagcaa

SEQ ID NO: 1097 - DNA, 26 bp, Artificial Sequence
  Synthetic Oligonucleotide
tggagattctccagcacgtcatcgac

SEQ ID NO: 1098 - DNA, 21 bp, Artificial Sequence
  Synthetic Oligonucleotide
tccaactgaaggtccctgatg

SEQ ID NO: 1099 - DNA, 23 bp, Artificial Sequence
  Synthetic Oligonucleotide
aacgactgctactccaagctcaa

SEQ ID NO: 1100 - DNA, 22 bp, Artificial Sequence
  Synthetic Oligonucleotide
tgcccagcatcccccagaacaa

SEQ ID NO: 1101 - DNA, 22 bp, Artificial Sequence
  Synthetic Oligonucleotide
ggatttccatcttgctcacctt

SEQ ID NO: 1102 - DNA, 20 bp, Artificial Sequence
  Synthetic Oligonucleotide
cttcaccaaatcccttcctg

SEQ ID NO: 1103 - DNA, 24 bp, Artificial Sequence
  Synthetic Oligonucleotide
tcacagtccttcgctcctgagcac

SEQ ID NO: 1104 - DNA, 20 bp, Artificial Sequence
  Synthetic Oligonucleotide
ctctggctcttcaggctaca

SEQ ID NO: 1105 - DNA, 19 bp, Artificial Sequence
  Synthetic Oligonucleotide
tggcctggctcttaatttg

SEQ ID NO: 1106 - DNA, 30 bp, Artificial Sequence
  Synthetic Oligonucleotide
cttttgttttgcccagtatagactcggaag

SEQ ID NO: 1107 - DNA, 19 bp, Artificial Sequence
  Synthetic Oligonucleotide
tgcaatcatgcaagaccac

SEQ ID NO: 1108 - DNA, 20 bp, Artificial Sequence
  Synthetic Oligonucleotide
tgacaaccaagcaaatgtga

SEQ ID NO: 1109 - DNA, 24 bp, Artificial Sequence
  Synthetic Oligonucleotide
aagttgccccaggtcaccagactc

SEQ ID NO: 1110 - DNA, 20 bp, Artificial Sequence
  Synthetic Oligonucleotide
cagtctgcccatgtggtaat

SEQ ID NO: 1111 - DNA, 21 bp, Artificial Sequence
  Synthetic Oligonucleotide
tccggagctgtgatctaagga

SEQ ID NO: 1112 - DNA, 24 bp, Artificial Sequence
  Synthetic Oligonucleotide
tgtattgcgcacccctcaagcctg

SEQ ID NO: 1113 - DNA, 20 bp, Artificial Sequence
  Synthetic Oligonucleotide
cggacagagcgagctgactt

SEQ ID NO: 1114 - DNA, 21 bp, Artificial Sequence
  Synthetic Oligonucleotide
gcatggtagccgaagatttca

SEQ ID NO: 1115 - DNA, 28 bp, Artificial Sequence
  Synthetic Oligonucleotide
cgcgtcataccaaaatctccgattttga

SEQ ID NO: 1116 - DNA, 30 bp, Artificial Sequence
  Synthetic Oligonucleotide
tttccggtaatagtctgtctcatagatatc

SEQ ID NO: 1117 - DNA, 19 bp, Artificial Sequence
  Synthetic Oligonucleotide
ccgtgcttccggacaactt

SEQ ID NO: 1118 - DNA, 24 bp, Artificial Sequence
  Synthetic Oligonucleotide
taccccgtgggcaagttcttccaa

SEQ ID NO: 1119 - DNA, 20 bp, Artificial Sequence
  Synthetic Oligonucleotide
tggactgcttccaggtgtca

SEQ ID NO: 1120 - DNA, 19 bp, Artificial Sequence
  Synthetic Oligonucleotide
gtggacagcaccatgaaca

SEQ ID NO: 1121 - DNA, 20 bp, Artificial Sequence
  Synthetic Oligonucleotide
cttccggccagcactgcctc

SEQ ID NO: 1122 - DNA, 20 bp, Artificial Sequence
  Synthetic Oligonucleotide
ccttcatacccgacttgagg

SEQ ID NO: 1123 - DNA, 17 bp, Artificial Sequence
  Synthetic Oligonucleotide
acgcaccgggtgtctga

SEQ ID NO: 1124 - DNA, 24 bp, Artificial Sequence
  Synthetic Oligonucleotide
cccaagttccaccccctccattca

SEQ ID NO: 1125 - DNA, 24 bp, Artificial Sequence
  Synthetic Oligonucleotide
tgccctttcttgatgatgattatc

SEQ ID NO: 1126 - DNA, 22 bp, Artificial Sequence
  Synthetic Oligonucleotide
tggacaagtacgggatgaagct

SEQ ID NO: 1127 - DNA, 24 bp, Artificial Sequence
  Synthetic Oligonucleotide
cccgtcaacgtactccatgcctgg

SEQ ID NO: 1128 - DNA, 21 bp, Artificial Sequence
  Synthetic Oligonucleotide
cgaaggtgtggcactgaaagt

SEQ ID NO: 1129 - DNA, 20 bp, Artificial Sequence
  Synthetic Oligonucleotide
tgaaccgcagagaccaacag

SEQ ID NO: 1130 - DNA, 25 bp, Artificial Sequence
  Synthetic Oligonucleotide
atccaggcacctctaccacgccctc

SEQ ID NO: 1131 - DNA, 20 bp, Artificial Sequence
  Synthetic Oligonucleotide
gtcttggacacccgcagaat

SEQ ID NO: 1132 - DNA, 23 bp, Artificial Sequence
  Synthetic Oligonucleotide
gggtcactatggagttcaaagga

SEQ ID NO: 1133 - DNA, 23 bp, Artificial Sequence
  Synthetic Oligonucleotide
cccggtcaccaggcaggagttct

SEQ ID NO: 1134 - DNA, 19 bp, Artificial Sequence
  Synthetic Oligonucleotide
gggtctgaatggccaggtt

SEQ ID NO: 1135 - DNA, 20 bp, Artificial Sequence
  Synthetic Oligonucleotide
aaggacgaggagaacacagg

SEQ ID NO: 1136 - DNA, 21 bp, Artificial Sequence
  Synthetic Oligonucleotide
atgacccagcgctgcaaggac

SEQ ID NO: 1137 - DNA, 20 bp, Artificial Sequence
  Synthetic Oligonucleotide
agatagccagcgagttcagg

SEQ ID NO: 1138 - DNA, 26 bp, Artificial Sequence
  Synthetic Oligonucleotide
aaggaaccatctcactgtgtgtaaac

SEQ ID NO: 1139 - DNA, 22 bp, Artificial Sequence
  Synthetic Oligonucleotide
tgacttccaagctggccgtggc

SEQ ID NO: 1140 - DNA, 20 bp, Artificial Sequence
  Synthetic Oligonucleotide
atcaggaaggctgccaagag

SEQ ID NO: 1141 - DNA, 20 bp, Artificial Sequence
  Synthetic Oligonucleotide
ggcgctgtcatcgatttctt

SEQ ID NO: 1142 - DNA, 22 bp, Artificial Sequence
  Synthetic Oligonucleotide
ctgctccacggccttgctcttg

SEQ ID NO: 1143 - DNA, 25 bp, Artificial Sequence
  Synthetic Oligonucleotide
tggagcttattaaaggcattcttca

SEQ ID NO: 1144 - DNA, 20 bp, Artificial Sequence
  Synthetic Oligonucleotide
agctgaggaagatgctggtt

SEQ ID NO: 1145 - DNA, 24 bp, Artificial Sequence
  Synthetic Oligonucleotide
tgcccacagaccttccaggagaat

SEQ ID NO: 1146 - DNA, 20 bp, Artificial Sequence
  Synthetic Oligonucleotide
ggaaagaaggtgctcaggtc

SEQ ID NO: 1147 - DNA, 20 bp, Artificial Sequence
  Synthetic Oligonucleotide
cctgaaccttccaaagatgg

SEQ ID NO: 1148 - DNA, 27 bp, Artificial Sequence
  Synthetic Oligonucleotide
ccagattggaagcatccatctttttca

SEQ ID NO: 1149 - DNA, 20 bp, Artificial Sequence
  Synthetic Oligonucleotide
accaggcaagtctcctcatt

SEQ ID NO: 1150 - DNA, 20 bp, Artificial Sequence
  Synthetic Oligonucleotide
ggcctaatgttccagatcct

SEQ ID NO: 1151 - DNA, 25 bp, Artificial Sequence
  Synthetic Oligonucleotide
catattgcccagtggtcacctcaca

SEQ ID NO: 1152 - DNA, 20 bp, Artificial Sequence
  Synthetic Oligonucleotide
aaaattgtgccttggaggag

SEQ ID NO: 1153 - DNA, 20 bp, Artificial Sequence
  Synthetic Oligonucleotide
agccatcactctcagtgcag

SEQ ID NO: 1154 - DNA, 22 bp, Artificial Sequence
  Synthetic Oligonucleotide
caggtcctatcgtggcccctga

SEQ ID NO: 1155 - DNA, 20 bp, Artificial Sequence
  Synthetic Oligonucleotide
actgcagagtcagggtctcc

SEQ ID NO: 1156 - DNA, 19 bp, Artificial Sequence
  Synthetic Oligonucleotide
gaaagtgtttgcggagcac

SEQ ID NO: 1157 - DNA, 24 bp, Artificial Sequence
  Synthetic Oligonucleotide
ctcctacagcggccagttcttggt

SEQ ID NO: 1158 - DNA, 18 bp, Artificial Sequence
  Synthetic Oligonucleotide
gaaggcgtagccggattt

SEQ ID NO: 1159 - DNA, 21 bp, Artificial Sequence
  Synthetic Oligonucleotide
caatctgatcccagggttgaa

SEQ ID NO: 1160 - DNA, 27 bp, Artificial Sequence
  Synthetic Oligonucleotide
ctcagcgcacttggcatcttttcaaca

SEQ ID NO: 1161 - DNA, 19 bp, Artificial Sequence
  Synthetic Oligonucleotide
ggccctgctggtggagata

SEQ ID NO: 1162 - DNA, 20 bp, Artificial Sequence
  Synthetic Oligonucleotide
tgtttccaagatcctgctga

SEQ ID NO: 1163 - DNA, 28 bp, Artificial Sequence
  Synthetic Oligonucleotide
ccatctttgctttatctgaggctcgttc

SEQ ID NO: 1164 - DNA, 20 bp, Artificial Sequence
  Synthetic Oligonucleotide
tctttctggttggctggaat

SEQ ID NO: 1165 - DNA, 20 bp, Artificial Sequence
  Synthetic Oligonucleotide
cctacagcaagtgcaaggaa

SEQ ID NO: 1166 - DNA, 24 bp, Artificial Sequence
  Synthetic Oligonucleotide
ccagctgcactttgtcgtcactgt

SEQ ID NO: 1167 - DNA, 20 bp, Artificial Sequence
  Synthetic Oligonucleotide
catctcgtaggtctgcatgg

SEQ ID NO: 1168 - DNA, 23 bp, Artificial Sequence
  Synthetic Oligonucleotide
cctcccagtttcatcttccacta

SEQ ID NO: 1169 - DNA, 24 bp, Artificial Sequence
  Synthetic Oligonucleotide
atgtgcagcccacaaccaccatga

SEQ ID NO: 1170 - DNA, 21 bp, Artificial Sequence
  Synthetic Oligonucleotide
agggactggaagggacaggtt

SEQ ID NO: 1171 - DNA, 19 bp, Artificial Sequence
  Synthetic Oligonucleotide
gtgcccgagccatatagca

SEQ ID NO: 1172 - DNA, 25 bp, Artificial Sequence
  Synthetic Oligonucleotide
acgtccgggtcctcactgtccttcc

SEQ ID NO: 1173 - DNA, 23 bp, Artificial Sequence
  Synthetic Oligonucleotide
cggtagtggttgatgactgttga

SEQ ID NO: 1174 - DNA, 20 bp, Artificial Sequence
  Synthetic Oligonucleotide
agcctccaggataccagcaa

SEQ ID NO: 1175 - DNA, 23 bp, Artificial Sequence
  Synthetic Oligonucleotide
agctaagctgccatttgtcaccg

SEQ ID NO: 1176 - DNA, 21 bp, Artificial Sequence
  Synthetic Oligonucleotide
tctccgactgacaggcatttg

SEQ ID NO: 1177 - DNA, 20 bp, Artificial Sequence
  Synthetic Oligonucleotide
ccacagctcaccttctgtca

SEQ ID NO: 1178 - DNA, 20 bp, Artificial Sequence
  Synthetic Oligonucleotide
tccatcccagctccagccag

SEQ ID NO: 1179 - DNA, 20 bp, Artificial Sequence
  Synthetic Oligonucleotide
cctcagtgccagtctcttcc

SEQ ID NO: 1180 - DNA, 20 bp, Artificial Sequence
  Synthetic Oligonucleotide
ccatgatcctcactctgctg

SEQ ID NO: 1181 - DNA, 24 bp, Artificial Sequence
  Synthetic Oligonucleotide
cactccagacctcgcttagcatgg

SEQ ID NO: 1182 - DNA, 20 bp, Artificial Sequence
  Synthetic Oligonucleotide
gaagctttgtagccggtgat

SEQ ID NO: 1183 - DNA, 21 bp, Artificial Sequence
  Synthetic Oligonucleotide
caacgcttcagtgatcaatcc

SEQ ID NO: 1184 - DNA, 24 bp, Artificial Sequence
  Synthetic Oligonucleotide
cgatcctgcatctgtaaatcgccc

SEQ ID NO: 1185 - DNA, 18 bp, Artificial Sequence
  Synthetic Oligonucleotide
gtctggccgggattcttt

SEQ ID NO: 1186 - DNA, 20 bp, Artificial Sequence
  Synthetic Oligonucleotide
aggccagccctacattatca

SEQ ID NO: 1187 - DNA, 24 bp, Artificial Sequence
  Synthetic Oligonucleotide
tctgagccttgtcctctatccggc

SEQ ID NO: 1188 - DNA, 20 bp, Artificial Sequence
  Synthetic Oligonucleotide
gtcttctccacagtccagca

SEQ ID NO: 1189 - DNA, 20 bp, Artificial Sequence
  Synthetic Oligonucleotide
cagtgacaaacagcccttcc

SEQ ID NO: 1190 - DNA, 24 bp, Artificial Sequence
  Synthetic Oligonucleotide
tcgccatcttttgtgggattcctt

SEQ ID NO: 1191 - DNA, 19 bp, Artificial Sequence
  Synthetic Oligonucleotide
gtttagcctcatgggcgtc

SEQ ID NO: 1192 - DNA, 22 bp, Artificial Sequence
  Synthetic Oligonucleotide
gatatgattggtcgctgctttg

SEQ ID NO: 1193 - DNA, 21 bp, Artificial Sequence
  Synthetic Oligonucleotide
cagccaggacctggccatccg

SEQ ID NO: 1194 - DNA, 21 bp, Artificial Sequence
  Synthetic Oligonucleotide
agaacttccattccccaccat

SEQ ID NO: 1195 - DNA, 21 bp, Artificial Sequence
  Synthetic Oligonucleotide
actcggactgcacaagctatt

SEQ ID NO: 1196 - DNA, 24 bp, Artificial Sequence
  Synthetic Oligonucleotide
ccgacagccacagaataacccaaa

SEQ ID NO: 1197 - DNA, 20 bp, Artificial Sequence
  Synthetic Oligonucleotide
tgccatcaccattgaaatct

SEQ ID NO: 1198 - DNA, 20 bp, Artificial Sequence
  Synthetic Oligonucleotide
tcagaattggatttggctca

SEQ ID NO: 1199 - DNA, 30 bp, Artificial Sequence
  Synthetic Oligonucleotide
tgctaatgtaaggcatcacagtcttttcca

SEQ ID NO: 1200 - DNA, 20 bp, Artificial Sequence
  Synthetic Oligonucleotide
cctgagcttagctggtgttg

SEQ ID NO: 1201 - DNA, 19 bp, Artificial Sequence
  Synthetic Oligonucleotide
accgggagccctacatgac

SEQ ID NO: 1202 - DNA, 28 bp, Artificial Sequence
  Synthetic Oligonucleotide
aaatacctgcaaccgttactgccgtgac

SEQ ID NO: 1203 - DNA, 27 bp, Artificial Sequence
  Synthetic Oligonucleotide
ccttaagctctttcactgactcaatct

SEQ ID NO: 1204 - DNA, 18 bp, Artificial Sequence
  Synthetic Oligonucleotide
caaggtgccctcagtgga

SEQ ID NO: 1205 - DNA, 24 bp, Artificial Sequence
  Synthetic Oligonucleotide
caccaacctgtacccgtattgcga

SEQ ID NO: 1206 - DNA, 19 bp, Artificial Sequence
  Synthetic Oligonucleotide
gcgcacaccttcatctcat

SEQ ID NO: 1207 - DNA, 20 bp, Artificial Sequence
  Synthetic Oligonucleotide
tcgtgaaagatgaccaggag

SEQ ID NO: 1208 - DNA, 27 bp, Artificial Sequence
  Synthetic Oligonucleotide
tgctatgtttctacaaaaccgccaagg

SEQ ID NO: 1209 - DNA, 20 bp, Artificial Sequence
  Synthetic Oligonucleotide
ggtgaacatcatgacgcagt

SEQ ID NO: 1210 - DNA, 20 bp, Artificial Sequence
  Synthetic Oligonucleotide
gtcaaaatggggagggacta

SEQ ID NO: 1211 - DNA, 29 bp, Artificial Sequence
  Synthetic Oligonucleotide
tgtatcttgttgagctatccaaactgccc

SEQ ID NO: 1212 - DNA, 20 bp, Artificial Sequence
  Synthetic Oligonucleotide
caggaccaccacagagtgag

SEQ ID NO: 1213 - DNA, 19 bp, Artificial Sequence
  Synthetic Oligonucleotide
gagcgcaaagtggaaatcg

SEQ ID NO: 1214 - DNA, 27 bp, Artificial Sequence
  Synthetic Oligonucleotide
taggaagcagctcccatctttccggta

SEQ ID NO: 1215 - DNA, 19 bp, Artificial Sequence
  Synthetic Oligonucleotide
tcttcacgggcaccacatc

SEQ ID NO: 1216 - DNA, 20 bp, Artificial Sequence
  Synthetic Oligonucleotide
tcctgctgctggtcatctac

SEQ ID NO: 1217 - DNA, 24 bp, Artificial Sequence
  Synthetic Oligonucleotide
tgtcttcacaccctactcggctgc

SEQ ID NO: 1218 - DNA, 20 bp, Artificial Sequence
  Synthetic Oligonucleotide
ccttcttccgtctccttcag

SEQ ID NO: 1219 - DNA, 18 bp, Artificial Sequence
  Synthetic Oligonucleotide
cctatcagccgctggtgt

SEQ ID NO: 1220 - DNA, 24 bp, Artificial Sequence
  Synthetic Oligonucleotide
atcctgctcggcctggcttacttc

SEQ ID NO: 1221 - DNA, 18 bp, Artificial Sequence
  Synthetic Oligonucleotide
tggtggtgagcactgagg

SEQ ID NO: 1222 - DNA, 20 bp, Artificial Sequence
  Synthetic Oligonucleotide
gaggacgaaggcctctacac

SEQ ID NO: 1223 - DNA, 24 bp, Artificial Sequence
  Synthetic Oligonucleotide
caggcatgcagtgttcttggctgt

SEQ ID NO: 1224 - DNA, 20 bp, Artificial Sequence
  Synthetic Oligonucleotide
aaaaatgcctccacttttgc

SEQ ID NO: 1225 - DNA, 19 bp, Artificial Sequence
  Synthetic Oligonucleotide
cggactttgggtgcgactt

SEQ ID NO: 1226 - DNA, 23 bp, Artificial Sequence
  Synthetic Oligonucleotide
ccacttgtcgaaccaccgctcgt

SEQ ID NO: 1227 - DNA, 24 bp, Artificial Sequence
  Synthetic Oligonucleotide
ttacaactcttccactgggacgat

SEQ ID NO: 1228 - DNA, 19 bp, Artificial Sequence
  Synthetic Oligonucleotide
gtgtcctggtccatgtggt

SEQ ID NO: 1229 - DNA, 24 bp, Artificial Sequence
  Synthetic Oligonucleotide
cacgtgtctccacctccaaggaga

SEQ ID NO: 1230 - DNA, 18 bp, Artificial Sequence
  Synthetic Oligonucleotide
gggaggtgcacactgagg

SEQ ID NO: 1231 - DNA, 20 bp, Artificial Sequence
  Synthetic Oligonucleotide
ctaaggcacttgctggaagg

SEQ ID NO: 1232 - DNA, 24 bp, Artificial Sequence
  Synthetic Oligonucleotide
tccataggcaagcacactggcatt

SEQ ID NO: 1233 - DNA, 18 bp, Artificial Sequence
  Synthetic Oligonucleotide
tcttcccagctcctgtgg

SEQ ID NO: 1234 - DNA, 25 bp, Artificial Sequence
  Synthetic Oligonucleotide
aattcctgctccaaaagaaagtctt

SEQ ID NO: 1235 - DNA, 22 bp, Artificial Sequence
  Synthetic Oligonucleotide
aagccgctccactcgcatgtcc

SEQ ID NO: 1236 - DNA, 20 bp, Artificial Sequence
  Synthetic Oligonucleotide
cgtgatgcgaagctctgaga

SEQ ID NO: 1237 - DNA, 20 bp, Artificial Sequence
  Synthetic Oligonucleotide
ccacagggttgaagaaccag

SEQ ID NO: 1238 - DNA, 24 bp, Artificial Sequence
  Synthetic Oligonucleotide
agccagttcctgctgttcctgtcc

SEQ ID NO: 1239 - DNA, 20 bp, Artificial Sequence
  Synthetic Oligonucleotide
cacctgatgtgccagacttc

SEQ ID NO: 1240 - DNA, 18 bp, Artificial Sequence
  Synthetic Oligonucleotide
gtccccgggatggatgtt

SEQ ID NO: 1241 - DNA, 29 bp, Artificial Sequence
  Synthetic Oligonucleotide
catctcgcttatccaacaatgacttggca

SEQ ID NO: 1242 - DNA, 25 bp, Artificial Sequence
  Synthetic Oligonucleotide
gatcagtcaagctgtctgacaattg

SEQ ID NO: 1243 - DNA, 18 bp, Artificial Sequence
  Synthetic Oligonucleotide
gtgcaaccgcagcttctc

SEQ ID NO: 1244 - DNA, 24 bp, Artificial Sequence
  Synthetic Oligonucleotide
ctctgaccacctggccctgcatat

SEQ ID NO: 1245 - DNA, 18 bp, Artificial Sequence
  Synthetic Oligonucleotide
cgggcagtgctcagttct

SEQ ID NO: 1246 - DNA, 20 bp, Artificial Sequence
  Synthetic Oligonucleotide
cacgagaccggctacttctc

SEQ ID NO: 1247 - DNA, 24 bp, Artificial Sequence
  Synthetic Oligonucleotide
agtactcctccagagacggcagcg

SEQ ID NO: 1248 - DNA, 20 bp, Artificial Sequence
  Synthetic Oligonucleotide
gctctaggcaggtctgttgc

SEQ ID NO: 1249 - DNA, 18 bp, Artificial Sequence
  Synthetic Oligonucleotide
gcccagaggctccatcgt

SEQ ID NO: 1250 - DNA, 23 bp, Artificial Sequence
  Synthetic Oligonucleotide
cctcttcctccccagtcggctga

SEQ ID NO: 1251 - DNA, 23 bp, Artificial Sequence
  Synthetic Oligonucleotide
cagaggtttgaacagtgcagaca

SEQ ID NO: 1252 - DNA, 20 bp, Artificial Sequence
  Synthetic Oligonucleotide
gacgtgagggtcctgattct

SEQ ID NO: 1253 - DNA, 24 bp, Artificial Sequence
  Synthetic Oligonucleotide
ttaccccagctccatccttgcatc

SEQ ID NO: 1254 - DNA, 20 bp, Artificial Sequence
  Synthetic Oligonucleotide
tcctcactcatcacgtcctc

SEQ ID NO: 1255 - DNA, 20 bp, Artificial Sequence
  Synthetic Oligonucleotide
tgagagccaggcttcttgta

SEQ ID NO: 1256 - DNA, 25 bp, Artificial Sequence
  Synthetic Oligonucleotide
tgtctcaaaatgccagccttctgaa

SEQ ID NO: 1257 - DNA, 20 bp, Artificial Sequence
  Synthetic Oligonucleotide
atcctggtcctctttgctgt

SEQ ID NO: 1258 - DNA, 20 bp, Artificial Sequence
  Synthetic Oligonucleotide
atgtgccagtgagcttgagt

SEQ ID NO: 1259 - DNA, 24 bp, Artificial Sequence
  Synthetic Oligonucleotide
ccttggagaaacacaagcacctgc

SEQ ID NO: 1260 - DNA, 20 bp, Artificial Sequence
  Synthetic Oligonucleotide
tgagcccctggttaacagta

SEQ ID NO: 1261 - DNA, 19 bp, Artificial Sequence
  Synthetic Oligonucleotide
gagaccaaggttgcaaggc

SEQ ID NO: 1262 - DNA, 24 bp, Artificial Sequence
  Synthetic Oligonucleotide
aagctcaaaggttcacacagggcc

SEQ ID NO: 1263 - DNA, 22 bp, Artificial Sequence
  Synthetic Oligonucleotide
cagtccatgctgtgaaactctc

SEQ ID NO: 1264 - DNA, 21 bp, Artificial Sequence
  Synthetic Oligonucleotide
tgagcggcagaatcaggagta

SEQ ID NO: 1265 - DNA, 24 bp, Artificial Sequence
  Synthetic Oligonucleotide
ctcatggacatcaagtcgcggctg

SEQ ID NO: 1266 - DNA, 19 bp, Artificial Sequence
  Synthetic Oligonucleotide
tgcggtaggtggcaatctc

SEQ ID NO: 1267 - DNA, 27 bp, Artificial Sequence
  Synthetic Oligonucleotide
ggatgaagcttacatgaacaaggtaga

SEQ ID NO: 1268 - DNA, 21 bp, Artificial Sequence
  Synthetic Oligonucleotide
cgtcggtcagcccttccaggc

SEQ ID NO: 1269 - DNA, 25 bp, Artificial Sequence
  Synthetic Oligonucleotide
catatagctgcctgaggaagttgat

SEQ ID NO: 1270 - DNA, 20 bp, Artificial Sequence
  Synthetic Oligonucleotide
cagatgaggcacatggagac

SEQ ID NO: 1271 - DNA, 24 bp, Artificial Sequence
  Synthetic Oligonucleotide
ctgattcctcaggtccttggcctg

SEQ ID NO: 1272 - DNA, 20 bp, Artificial Sequence
  Synthetic Oligonucleotide
ttgaaatggcagaacggtag

SEQ ID NO: 1273 - DNA, 20 bp, Artificial Sequence
  Synthetic Oligonucleotide
actgaccaagcctgagacct

SEQ ID NO: 1274 - DNA, 23 bp, Artificial Sequence
  Synthetic Oligonucleotide
ccactcgccatactgggtgcagt

SEQ ID NO: 1275 - DNA, 20 bp, Artificial Sequence
  Synthetic Oligonucleotide
gtcacacttgcagcatttca

SEQ ID NO: 1276 - DNA, 21 bp, Artificial Sequence
  Synthetic Oligonucleotide
actcaagcggaaattgaagca

SEQ ID NO: 1277 - DNA, 28 bp, Artificial Sequence
  Synthetic Oligonucleotide
aggtcttatcagcacagtctccgcctcc

SEQ ID NO: 1278 - DNA, 21 bp, Artificial Sequence
  Synthetic Oligonucleotide
actccctgaagccgagacact

SEQ ID NO: 1279 - DNA, 18 bp, Artificial Sequence
  Synthetic Oligonucleotide
gtgaacgttccggagagc

SEQ ID NO: 1280 - DNA, 24 bp, Artificial Sequence
  Synthetic Oligonucleotide
atccagagacgcttctgcgctctc

SEQ ID NO: 1281 - DNA, 20 bp, Artificial Sequence
  Synthetic Oligonucleotide
acattcacatactcccggct

SEQ ID NO: 1282 - DNA, 19 bp, Artificial Sequence
  Synthetic Oligonucleotide
cgctgggcaacattaagag

SEQ ID NO: 1283 - DNA, 24 bp, Artificial Sequence
  Synthetic Oligonucleotide
tcaccactcggacgaggtaactcg

SEQ ID NO: 1284 - DNA, 21 bp, Artificial Sequence
  Synthetic Oligonucleotide
agcatgctggttgtagttggt

SEQ ID NO: 1285 - DNA, 18 bp, Artificial Sequence
  Synthetic Oligonucleotide
cagtgcctctcgcctgtc

SEQ ID NO: 1286 - DNA, 23 bp, Artificial Sequence
  Synthetic Oligonucleotide
actgggacaagcctgacagcagc

SEQ ID NO: 1287 - DNA, 21 bp, Artificial Sequence
  Synthetic Oligonucleotide
tgaagaggtcatcctgctctg

SEQ ID NO: 1288 - DNA, 19 bp, Artificial Sequence
  Synthetic Oligonucleotide
gatgacggaaagcatccag

SEQ ID NO: 1289 - DNA, 24 bp, Artificial Sequence
  Synthetic Oligonucleotide
tggaggcctctacaacaagggacc

SEQ ID NO: 1290 - DNA, 21 bp, Artificial Sequence
  Synthetic Oligonucleotide
cccggaataactcgagtagga

SEQ ID NO: 1291 - DNA, 20 bp, Artificial Sequence
  Synthetic Oligonucleotide
agcggaaaatggcagacaat

SEQ ID NO: 1292 - DNA, 25 bp, Artificial Sequence
  Synthetic Oligonucleotide
acccagataacgcatcatggagcga

SEQ ID NO: 1293 - DNA, 20 bp, Artificial Sequence
  Synthetic Oligonucleotide
cttgagggtttgggtttcca

SEQ ID NO: 1294 - DNA, 21 bp, Artificial Sequence
  Synthetic Oligonucleotide
ttggtgccgttcctatagatg

SEQ ID NO: 1295 - DNA, 24 bp, Artificial Sequence
  Synthetic Oligonucleotide
cagtgcttgcctccatcttcagga

SEQ ID NO: 1296 - DNA, 18 bp, Artificial Sequence
  Synthetic Oligonucleotide
gaacctgccacgatcacc

SEQ ID NO: 1297 - DNA, 21 bp, Artificial Sequence
  Synthetic Oligonucleotide
cacctggtctgggaagatacc

SEQ ID NO: 1298 - DNA, 24 bp, Artificial Sequence
  Synthetic Oligonucleotide
accgagaccccaatcaaaacctcc

SEQ ID NO: 1299 - DNA, 19 bp, Artificial Sequence
  Synthetic Oligonucleotide
aagagcagcaggacgaagg

SEQ ID NO: 1300 - DNA, 19 bp, Artificial Sequence
  Synthetic Oligonucleotide
tgcaaacgctggtgtcaca

SEQ ID NO: 1301 - DNA, 22 bp, Artificial Sequence
  Synthetic Oligonucleotide
cagccccccaactgacctcatc

SEQ ID NO: 1302 - DNA, 21 bp, Artificial Sequence
  Synthetic Oligonucleotide
ccccacgagttctggttcttc

SEQ ID NO: 1303 - DNA, 20 bp, Artificial Sequence
  Synthetic Oligonucleotide
cccatccagaacactgattg

SEQ ID NO: 1304 - DNA, 26 bp, Artificial Sequence
  Synthetic Oligonucleotide
tgacctccatccctttcacttgaatg

SEQ ID NO: 1305 - DNA, 21 bp, Artificial Sequence
  Synthetic Oligonucleotide
ctgctttctatgcaccctttc

SEQ ID NO: 1306 - DNA, 18 bp, Artificial Sequence
  Synthetic Oligonucleotide
ccaatgggagaacaacgg

SEQ ID NO: 1307 - DNA, 24 bp, Artificial Sequence
  Synthetic Oligonucleotide
caggctcagcaagctgaacacctg

SEQ ID NO: 1308 - DNA, 19 bp, Artificial Sequence
  Synthetic Oligonucleotide
cgctgaggctggtactgtg

SEQ ID NO: 1309 - DNA, 19 bp, Artificial Sequence
  Synthetic Oligonucleotide
tcagcgggctcttaaacaa

SEQ ID NO: 1310 - DNA, 24 bp, Artificial Sequence
  Synthetic Oligonucleotide
cagctgtccccgcagtaaagaagc

SEQ ID NO: 1311 - DNA, 20 bp, Artificial Sequence
  Synthetic Oligonucleotide
aagacaggagttgaccacgc

SEQ ID NO: 1312 - DNA, 20 bp, Artificial Sequence
  Synthetic Oligonucleotide
cgactatgacccactggaca

SEQ ID NO: 1313 - DNA, 24 bp, Artificial Sequence
  Synthetic Oligonucleotide
cgcccatccacccagtagatgaac

SEQ ID NO: 1314 - DNA, 19 bp, Artificial Sequence
  Synthetic Oligonucleotide
cttggctcgcttgatgttc

SEQ ID NO: 1315 - DNA, 20 bp, Artificial Sequence
  Synthetic Oligonucleotide
ggatgtagccatctctgcct

SEQ ID NO: 1316 - DNA, 24 bp, Artificial Sequence
  Synthetic Oligonucleotide
atagacctcagggccttcgctgtg

SEQ ID NO: 1317 - DNA, 20 bp, Artificial Sequence
  Synthetic Oligonucleotide
agttcaaagccaatagggca

SEQ ID NO: 1318 - DNA, 21 bp, Artificial Sequence
  Synthetic Oligonucleotide
aatgctgatgacttggagcag

SEQ ID NO: 1319 - DNA, 24 bp, Artificial Sequence
  Synthetic Oligonucleotide
cacagaccccacagaggatgaagc

SEQ ID NO: 1320 - DNA, 18 bp, Artificial Sequence
  Synthetic Oligonucleotide
ctgcatcctctgtggggt

SEQ ID NO: 1321 - DNA, 26 bp, Artificial Sequence
  Synthetic Oligonucleotide
tggttctgattaggtaacgtattgga

SEQ ID NO: 1322 - DNA, 25 bp, Artificial Sequence
  Synthetic Oligonucleotide
ctgcccacaactcccttgcacgtaa

SEQ ID NO: 1323 - DNA, 21 bp, Artificial Sequence
  Synthetic Oligonucleotide
ggtcaaggtgggacactgaag

SEQ ID NO: 1324 - DNA, 20 bp, Artificial Sequence
  Synthetic Oligonucleotide
agaagctgtccctgcaagag

SEQ ID NO: 1325 - DNA, 25 bp, Artificial Sequence
  Synthetic Oligonucleotide
catgttcttcacaatcgctgcatcc

SEQ ID NO: 1326 - DNA, 20 bp, Artificial Sequence
  Synthetic Oligonucleotide
agccgtaccagctcagactt

SEQ ID NO: 1327 - DNA, 18 bp, Artificial Sequence
  Synthetic Oligonucleotide
ccgggagcagggaatcac

SEQ ID NO: 1328 - DNA, 19 bp, Artificial Sequence
  Synthetic Oligonucleotide
cggccacgatttcggcgct

SEQ ID NO: 1329 - DNA, 20 bp, Artificial Sequence
  Synthetic Oligonucleotide
atgctgttgatgccgaatga

SEQ ID NO: 1330 - DNA, 23 bp, Artificial Sequence
  Synthetic Oligonucleotide
gctgcctttggtaagaacatgtc

SEQ ID NO: 1331 - DNA, 22 bp, Artificial Sequence
  Synthetic Oligonucleotide
tccatcttgccattcacgccgc

SEQ ID NO: 1332 - DNA, 23 bp, Artificial Sequence
  Synthetic Oligonucleotide
atcccagcagtctcttcacaact

SEQ ID NO: 1333 - DNA, 22 bp, Artificial Sequence
  Synthetic Oligonucleotide
ggacattactggcctgttcaca

SEQ ID NO: 1334 - DNA, 23 bp, Artificial Sequence
  Synthetic Oligonucleotide
tgcattccagcctcccatttcca

SEQ ID NO: 1335 - DNA, 23 bp, Artificial Sequence
  Synthetic Oligonucleotide
accaatactcaggagcaggatga

SEQ ID NO: 1336 - DNA, 20 bp, Artificial Sequence
  Synthetic Oligonucleotide
tccatcaaggctttcgacta

SEQ ID NO: 1337 - DNA, 22 bp, Artificial Sequence
  Synthetic Oligonucleotide
ctgcaggctgtacgccttctcg

SEQ ID NO: 1338 - DNA, 20 bp, Artificial Sequence
  Synthetic Oligonucleotide
ctgctgcataaactcgtggt

SEQ ID NO: 1339 - DNA, 18 bp, Artificial Sequence
  Synthetic Oligonucleotide
cggaccaccaggtcagag

SEQ ID NO: 1340 - DNA, 24 bp, Artificial Sequence
  Synthetic Oligonucleotide
ccactcttccctgctctgcgaatt

SEQ ID NO: 1341 - DNA, 20 bp, Artificial Sequence
  Synthetic Oligonucleotide
caggggtagtgggtgttgag

SEQ ID NO: 1342 - DNA, 23 bp, Artificial Sequence
  Synthetic Oligonucleotide
gcctttcttacccagaagcagaa

SEQ ID NO: 1343 - DNA, 30 bp, Artificial Sequence
  Synthetic Oligonucleotide
tctcaaagtcgtcatccttcagttctccca

SEQ ID NO: 1344 - DNA, 19 bp, Artificial Sequence
  Synthetic Oligonucleotide
cagcccccagctcactgat

SEQ ID NO: 1345 - DNA, 20 bp, Artificial Sequence
  Synthetic Oligonucleotide
ggttggcatcaaaaggaact

SEQ ID NO: 1346 - DNA, 26 bp, Artificial Sequence
  Synthetic Oligonucleotide
aattgtccctgaaactctcctgcacc

SEQ ID NO: 1347 - DNA, 20 bp, Artificial Sequence
  Synthetic Oligonucleotide
tgccataaatgcaattgtcc

SEQ ID NO: 1348 - DNA, 23 bp, Artificial Sequence
  Synthetic Oligonucleotide
tgagtggaaaagcctgacctatg

SEQ ID NO: 1349 - DNA, 27 bp, Artificial Sequence
  Synthetic Oligonucleotide
tgaagtcatcagctttgtgccaccacc

SEQ ID NO: 1350 - DNA, 23 bp, Artificial Sequence
  Synthetic Oligonucleotide
ggactccatctcttcttggtcaa

SEQ ID NO: 1351 - DNA, 23 bp, Artificial Sequence
  Synthetic Oligonucleotide
cagatggccactttgagaacatt

SEQ ID NO: 1352 - DNA, 28 bp, Artificial Sequence
  Synthetic Oligonucleotide
agctgacaacagtgtgaacgaccagacc

SEQ ID NO: 1353 - DNA, 22 bp, Artificial Sequence
  Synthetic Oligonucleotide
ggcagcattaaccacaaggatt

SEQ ID NO: 1354 - DNA, 21 bp, Artificial Sequence
  Synthetic Oligonucleotide
caaacgggctcatcataatgc

SEQ ID NO: 1355 - DNA, 27 bp, Artificial Sequence
  Synthetic Oligonucleotide
tgatgtggtccctacgttttcgttcca

SEQ ID NO: 1356 - DNA, 20 bp, Artificial Sequence
  Synthetic Oligonucleotide
tcccgcaaactgtgaaagct

SEQ ID NO: 1357 - DNA, 21 bp, Artificial Sequence
  Synthetic Oligonucleotide
gacttttgcccgctacctttc

SEQ ID NO: 1358 - DNA, 24 bp, Artificial Sequence
  Synthetic Oligonucleotide
acagctcattgttgtcacgccgga

SEQ ID NO: 1359 - DNA, 26 bp, Artificial Sequence
  Synthetic Oligonucleotide
gccactaactgcttcagtatgaagag

SEQ ID NO: 1360 - DNA, 20 bp, Artificial Sequence
  Synthetic Oligonucleotide
ggagaacaatccccttgaga

SEQ ID NO: 1361 - DNA, 27 bp, Artificial Sequence
  Synthetic Oligonucleotide
tggcctttctgtctacaaggatcacca

SEQ ID NO: 1362 - DNA, 20 bp, Artificial Sequence
  Synthetic Oligonucleotide
atctcctggatggtgatggt

SEQ ID NO: 1363 - DNA, 24 bp, Artificial Sequence
  Synthetic Oligonucleotide
tgatggtcctatgtgtcacattca

SEQ ID NO: 1364 - DNA, 30 bp, Artificial Sequence
  Synthetic Oligonucleotide
caggtttcataccaacacaggcttcagcac

SEQ ID NO: 1365 - DNA, 20 bp, Artificial Sequence
  Synthetic Oligonucleotide
tgggacaggaaacacaccaa

SEQ ID NO: 1366 - DNA, 19 bp, Artificial Sequence
  Synthetic Oligonucleotide
cgctcagccagatgcaatc

SEQ ID NO: 1367 - DNA, 21 bp, Artificial Sequence
  Synthetic Oligonucleotide
tgccccagtcacctgctgtta

SEQ ID NO: 1368 - DNA, 25 bp, Artificial Sequence
  Synthetic Oligonucleotide
gcactgagatcttcctattggtgaa

SEQ ID NO: 1369 - DNA, 19 bp, Artificial Sequence
  Synthetic Oligonucleotide
ggagccgactgcaagtaca

SEQ ID NO: 1370 - DNA, 24 bp, Artificial Sequence
  Synthetic Oligonucleotide
atcacacgcaccccagttctcaaa

SEQ ID NO: 1371 - DNA, 18 bp, Artificial Sequence
  Synthetic Oligonucleotide
gactttggtgcctgtgcc

SEQ ID NO: 1372 - DNA, 19 bp, Artificial Sequence
  Synthetic Oligonucleotide
ctacagggacgccatcgaa

SEQ ID NO: 1373 - DNA, 23 bp, Artificial Sequence
  Synthetic Oligonucleotide
cttacaccagcatcaagatccgg

SEQ ID NO: 1374 - DNA, 23 bp, Artificial Sequence
  Synthetic Oligonucleotide
atccaaccaatcacctgaatgtt

SEQ ID NO: 1375 - DNA, 20 bp, Artificial Sequence
  Synthetic Oligonucleotide
ggagtcgaaggtggacaatc

SEQ ID NO: 1376 - DNA, 24 bp, Artificial Sequence
  Synthetic Oligonucleotide
aatggcaccggaacaaactcaacc

SEQ ID NO: 1377 - DNA, 21 bp, Artificial Sequence
  Synthetic Oligonucleotide
tgggaacagctgtagtggagt

SEQ ID NO: 1378 - DNA, 20 bp, Artificial Sequence
  Synthetic Oligonucleotide
gtgaaatgaaacgcaccaca

SEQ ID NO: 1379 - DNA, 20 bp, Artificial Sequence
  Synthetic Oligonucleotide
cagccctttggggaagctgg

SEQ ID NO: 1380 - DNA, 20 bp, Artificial Sequence
  Synthetic Oligonucleotide
gaccctgctcacaaccagac

SEQ ID NO: 1381 - DNA, 21 bp, Artificial Sequence
  Synthetic Oligonucleotide
acggatctaccacaccattgc

SEQ ID NO: 1382 - DNA, 22 bp, Artificial Sequence
  Synthetic Oligonucleotide
tttgacaccccttccccagcca

SEQ ID NO: 1383 - DNA, 26 bp, Artificial Sequence
  Synthetic Oligonucleotide
tccatatccaacaaaaaaactcaaag

SEQ ID NO: 1384 - DNA, 21 bp, Artificial Sequence
  Synthetic Oligonucleotide
gggagatcatcgggacaactc

SEQ ID NO: 1385 - DNA, 30 bp, Artificial Sequence
  Synthetic Oligonucleotide
agcaagatttcctccaggtccatcaaaagg

SEQ ID NO: 1386 - DNA, 19 bp, Artificial Sequence
  Synthetic Oligonucleotide
gggcctggttgaaaagcat

SEQ ID NO: 1387 - DNA, 19 bp, Artificial Sequence
  Synthetic Oligonucleotide
ccaacgcttgccaaatcct

SEQ ID NO: 1388 - DNA, 24 bp, Artificial Sequence
  Synthetic Oligonucleotide
aaccagctctctgtgaccccaatt

SEQ ID NO: 1389 - DNA, 24 bp, Artificial Sequence
  Synthetic Oligonucleotide
acggtagtgacagcatcaaaactc

SEQ ID NO: 1390 - DNA, 20 bp, Artificial Sequence
  Synthetic Oligonucleotide
ccatgatggagaggcagaca

SEQ ID NO: 1391 - DNA, 24 bp, Artificial Sequence
  Synthetic Oligonucleotide
ctgggagcatggcgatggataccc

SEQ ID NO: 1392 - DNA, 21 bp, Artificial Sequence
  Synthetic Oligonucleotide
ggagtccgtccttaccgtcaa

SEQ ID NO: 1393 - DNA, 26 bp, Artificial Sequence
  Synthetic Oligonucleotide
ggatggtagcagtctagggattaact

SEQ ID NO: 1394 - DNA, 28 bp, Artificial Sequence
  Synthetic Oligonucleotide
cctgtatgctgcaactcatgaacttggc

SEQ ID NO: 1395 - DNA, 22 bp, Artificial Sequence
  Synthetic Oligonucleotide
ggaatgtcccatacccaaagaa

SEQ ID NO: 1396 - DNA, 20 bp, Artificial Sequence
  Synthetic Oligonucleotide
gagaaccaatctcaccgaca

SEQ ID NO: 1397 - DNA, 24 bp, Artificial Sequence
  Synthetic Oligonucleotide
acaggtattcctctgccagctgcc

SEQ ID NO: 1398 - DNA, 20 bp, Artificial Sequence
  Synthetic Oligonucleotide
cacccgagtgtaaccatagc

SEQ ID NO: 1399 - DNA, 18 bp, Artificial Sequence
  Synthetic Oligonucleotide
tcatggtgcccgtcaatg

SEQ ID NO: 1400 - DNA, 29 bp, Artificial Sequence
  Synthetic Oligonucleotide
acctgatacgtcttggtcttcatcgccat

SEQ ID NO: 1401 - DNA, 23 bp, Artificial Sequence
  Synthetic Oligonucleotide
cgattgtctttgctcttcatgtg

SEQ ID NO: 1402 - DNA, 20 bp, Artificial Sequence
  Synthetic Oligonucleotide
aggggatgacttggacacat

SEQ ID NO: 1403 - DNA, 25 bp, Artificial Sequence
  Synthetic Oligonucleotide
ctgccattcgacatgactgcaattt

SEQ ID NO: 1404 - DNA, 20 bp, Artificial Sequence
  Synthetic Oligonucleotide
aaaactgcatggctttgtca

SEQ ID NO: 1405 - DNA, 22 bp, Artificial Sequence
  Synthetic Oligonucleotide
tcatcctggcgatctacttcct

SEQ ID NO: 1406 - DNA, 26 bp, Artificial Sequence
  Synthetic Oligonucleotide
tctgtcctggctggagtcgctttcat

SEQ ID NO: 1407 - DNA, 20 bp, Artificial Sequence
  Synthetic Oligonucleotide
ccgttgagtggaatcagcaa

SEQ ID NO: 1408 - DNA, 20 bp, Artificial Sequence
  Synthetic Oligonucleotide
agcgcctggaatctacaact

SEQ ID NO: 1409 - DNA, 24 bp, Artificial Sequence
  Synthetic Oligonucleotide
cggagtccagtgttttcccacttg

SEQ ID NO: 1410 - DNA, 20 bp, Artificial Sequence
  Synthetic Oligonucleotide
agagcccctggagagaagat

SEQ ID NO: 1411 - DNA, 20 bp, Artificial Sequence
  Synthetic Oligonucleotide
acttgcaggctgctatcctt

SEQ ID NO: 1412 - DNA, 25 bp, Artificial Sequence
  Synthetic Oligonucleotide
ttcctactctcaggggcagcatgtt

SEQ ID NO: 1413 - DNA, 20 bp, Artificial Sequence
  Synthetic Oligonucleotide
agcagacttgaaccctggtc

SEQ ID NO: 1414 - DNA, 20 bp, Artificial Sequence
  Synthetic Oligonucleotide
gatgcagaattgaggcagac

SEQ ID NO: 1415 - DNA, 29 bp, Artificial Sequence
  Synthetic Oligonucleotide
caagaagatttacttcgtcgattcccaga

SEQ ID NO: 1416 - DNA, 20 bp, Artificial Sequence
  Synthetic Oligonucleotide
tcttggcaagtcggttaaga

SEQ ID NO: 1417 - DNA, 21 bp, Artificial Sequence
  Synthetic Oligonucleotide
tgattaccatcatggctcaga

SEQ ID NO: 1418 - DNA, 24 bp, Artificial Sequence
  Synthetic Oligonucleotide
tcccaattgtcgcttcttctgcag

SEQ ID NO: 1419 - DNA, 20 bp, Artificial Sequence
  Synthetic Oligonucleotide
cttgtgaaaatgccatccac

SEQ ID NO: 1420 - DNA, 20 bp, Artificial Sequence
  Synthetic Oligonucleotide
tctattgggggattggtagg

SEQ ID NO: 1421 - DNA, 26 bp, Artificial Sequence
  Synthetic Oligonucleotide
ccgttaccagctggaaattcctgaga

SEQ ID NO: 1422 - DNA, 20 bp, Artificial Sequence
  Synthetic Oligonucleotide
caaattgcgagtggtgaaat

SEQ ID NO: 1423 - DNA, 20 bp, Artificial Sequence
  Synthetic Oligonucleotide
gtgtgagaagtgtgccaagg

SEQ ID NO: 1424 - DNA, 23 bp, Artificial Sequence
  Synthetic Oligonucleotide
ctctccgcctttgcacacacagt

SEQ ID NO: 1425 - DNA, 20 bp, Artificial Sequence
  Synthetic Oligonucleotide
ctgcacttctctgcttctgc

SEQ ID NO: 1426 - DNA, 19 bp, Artificial Sequence
  Synthetic Oligonucleotide
ccgccctcacctgaagaga

SEQ ID NO: 1427 - DNA, 21 bp, Artificial Sequence
  Synthetic Oligonucleotide
cccagtgtccgccaaggagcg

SEQ ID NO: 1428 - DNA, 22 bp, Artificial Sequence
  Synthetic Oligonucleotide
ggaataagttagccgcgcttct

SEQ ID NO: 1429 - DNA, 20 bp, Artificial Sequence
  Synthetic Oligonucleotide
ggccaggatctgtggtggta

SEQ ID NO: 1430 - DNA, 23 bp, Artificial Sequence
  Synthetic Oligonucleotide
ctctggccttccgagaaggtacc

SEQ ID NO: 1431 - DNA, 20 bp, Artificial Sequence
  Synthetic Oligonucleotide
ctccacgtcgtggacattga

SEQ ID NO: 1432 - DNA, 20 bp, Artificial Sequence
  Synthetic Oligonucleotide
ctatgagccatgtgggaacc

SEQ ID NO: 1433 - DNA, 24 bp, Artificial Sequence
  Synthetic Oligonucleotide
agcttcgagacctgcaggaccatc

SEQ ID NO: 1434 - DNA, 18 bp, Artificial Sequence
  Synthetic Oligonucleotide
atgttggagtggatgccg

SEQ ID NO: 1435 - DNA, 19 bp, Artificial Sequence
  Synthetic Oligonucleotide
tgcccttgcactgtcctaa

SEQ ID NO: 1436 - DNA, 24 bp, Artificial Sequence
  Synthetic Oligonucleotide
tcagccatcctgcacacctacacc

SEQ ID NO: 1437 - DNA, 18 bp, Artificial Sequence
  Synthetic Oligonucleotide
cagccacactcatccacg

SEQ ID NO: 1438 - DNA, 20 bp, Artificial Sequence
  Synthetic Oligonucleotide
gtacgaccaagagaaacggg

SEQ ID NO: 1439 - DNA, 24 bp, Artificial Sequence
  Synthetic Oligonucleotide
tctgcccgtcttctccatggtagg

SEQ ID NO: 1440 - DNA, 19 bp, Artificial Sequence
  Synthetic Oligonucleotide
cctgtccaggtccatctca

SEQ ID NO: 1441 - DNA, 22 bp, Artificial Sequence
  Synthetic Oligonucleotide
acgagaacgagggcatctatgt

SEQ ID NO: 1442 - DNA, 25 bp, Artificial Sequence
  Synthetic Oligonucleotide
cgcacctttccggtcttgacatcct

SEQ ID NO: 1443 - DNA, 22 bp, Artificial Sequence
  Synthetic Oligonucleotide
gcatgtaggtgcttccaatcac

SEQ ID NO: 1444 - DNA, 23 bp, Artificial Sequence
  Synthetic Oligonucleotide
gaaggaatgggaatcagtcatga

SEQ ID NO: 1445 - DNA, 23 bp, Artificial Sequence
  Synthetic Oligonucleotide
tcaccctggagatcagctcccga

SEQ ID NO: 1446 - DNA, 26 bp, Artificial Sequence
  Synthetic Oligonucleotide
gtctattagagtcagatccgggacat

SEQ ID NO: 1447 - DNA, 20 bp, Artificial Sequence
  Synthetic Oligonucleotide
agaaactggaggagcaggac

SEQ ID NO: 1448 - DNA, 24 bp, Artificial Sequence
  Synthetic Oligonucleotide
tgcagctgctccttgatgctcagt

SEQ ID NO: 1449 - DNA, 20 bp, Artificial Sequence
  Synthetic Oligonucleotide
cttcaggaaacgatgctcct

SEQ ID NO: 1450 - DNA, 18 bp, Artificial Sequence
  Synthetic Oligonucleotide
gccgagatcgccaagatg

SEQ ID NO: 1451 - DNA, 24 bp, Artificial Sequence
  Synthetic Oligonucleotide
cagcattgtctgtcctccctggca

SEQ ID NO: 1452 - DNA, 27 bp, Artificial Sequence
  Synthetic Oligonucleotide
cttttgatggtagagttccagtgattc

SEQ ID NO: 1453 - DNA, 27 bp, Artificial Sequence
  Synthetic Oligonucleotide
cggtacttctcagggctaatatatacg

SEQ ID NO: 1454 - DNA, 26 bp, Artificial Sequence
  Synthetic Oligonucleotide
ctcttctgcgtggtggtcaaccccta

SEQ ID NO: 1455 - DNA, 21 bp, Artificial Sequence
  Synthetic Oligonucleotide
ccgagtagatgggcaggtgtt

SEQ ID NO: 1456 - DNA, 19 bp, Artificial Sequence
  Synthetic Oligonucleotide
tgacggagcgtgagtgcat

SEQ ID NO: 1457 - DNA, 25 bp, Artificial Sequence
  Synthetic Oligonucleotide
ccctccgagatctgccgcatgtact

SEQ ID NO: 1458 - DNA, 21 bp, Artificial Sequence
  Synthetic Oligonucleotide
atgccctgcttgtggatgtac

SEQ ID NO: 1459 - DNA, 25 bp, Artificial Sequence
  Synthetic Oligonucleotide
taactgacattcttgagcaccagat

SEQ ID NO: 1460 - DNA, 28 bp, Artificial Sequence
  Synthetic Oligonucleotide
cgggctgttccctttgagaaccttaaca

SEQ ID NO: 1461 - DNA, 18 bp, Artificial Sequence
  Synthetic Oligonucleotide
atggcttgcccacaatgc

SEQ ID NO: 1462 - DNA, 19 bp, Artificial Sequence
  Synthetic Oligonucleotide
ctctcccagcacagcttga

SEQ ID NO: 1463 - DNA, 24 bp, Artificial Sequence
  Synthetic Oligonucleotide
cctcactgagtcaaccagcctgga

SEQ ID NO: 1464 - DNA, 20 bp, Artificial Sequence
  Synthetic Oligonucleotide
caccagtgtcatccagcaac

SEQ ID NO: 1465 - DNA, 20 bp, Artificial Sequence
  Synthetic Oligonucleotide
tagttcccagctgaccatca

SEQ ID NO: 1466 - DNA, 25 bp, Artificial Sequence
  Synthetic Oligonucleotide
ctcagcctcgtcgttcttatccacc

SEQ ID NO: 1467 - DNA, 20 bp, Artificial Sequence
  Synthetic Oligonucleotide
cagccttgttctcagcaatg

SEQ ID NO: 1468 - DNA, 18 bp, Artificial Sequence
  Synthetic Oligonucleotide
ctactgcggaaagtcggg

SEQ ID NO: 1469 - DNA, 24 bp, Artificial Sequence
  Synthetic Oligonucleotide
ctggagtccaaactcgcttcctgc

SEQ ID NO: 1470 - DNA, 21 bp, Artificial Sequence
  Synthetic Oligonucleotide
ggactgatcgtacacgaggtt

SEQ ID NO: 1471 - DNA, 18 bp, Artificial Sequence
  Synthetic Oligonucleotide
agggcaacattccacagc

SEQ ID NO: 1472 - DNA, 24 bp, Artificial Sequence
  Synthetic Oligonucleotide
ctgcaaggacactcatcacagcca

SEQ ID NO: 1473 - DNA, 18 bp, Artificial Sequence
  Synthetic Oligonucleotide
cagtgctcctactccggc

SEQ ID NO: 1474 - DNA, 19 bp, Artificial Sequence
  Synthetic Oligonucleotide
tatccatcctgatggcgtc

SEQ ID NO: 1475 - DNA, 24 bp, Artificial Sequence
  Synthetic Oligonucleotide
cccagtgctgactttcctcaggga

SEQ ID NO: 1476 - DNA, 20 bp, Artificial Sequence
  Synthetic Oligonucleotide
ttgaactgtgcattggtgtg

SEQ ID NO: 1477 - DNA, 21 bp, Artificial Sequence
  Synthetic Oligonucleotide
tgctggctactgggtgttagt

SEQ ID NO: 1478 - DNA, 24 bp, Artificial Sequence
  Synthetic Oligonucleotide
tgcagtcctgtgtgcttccctctc

SEQ ID NO: 1479 - DNA, 20 bp, Artificial Sequence
  Synthetic Oligonucleotide
gacaaccagggacacagtca

SEQ ID NO: 1480 - DNA, 18 bp, Artificial Sequence
  Synthetic Oligonucleotide
gtgaggcagcgcgactct

SEQ ID NO: 1481 - DNA, 21 bp, Artificial Sequence
  Synthetic Oligonucleotide
tgccttcccgggctgaggact

SEQ ID NO: 1482 - DNA, 23 bp, Artificial Sequence
  Synthetic Oligonucleotide
tgccaatggtgtacaacacttca

SEQ ID NO: 1483 - DNA, 20 bp, Artificial Sequence
  Synthetic Oligonucleotide
actccagagctgacctccac

SEQ ID NO: 1484 - DNA, 24 bp, Artificial Sequence
  Synthetic Oligonucleotide
ctacaatgacttcccaggctgggc

SEQ ID NO: 1485 - DNA, 20 bp, Artificial Sequence
  Synthetic Oligonucleotide
tcagggcttcagtgtctcac

SEQ ID NO: 1486 - DNA, 20 bp, Artificial Sequence
  Synthetic Oligonucleotide
cagaccaaggagatggacct

SEQ ID NO: 1487 - DNA, 24 bp, Artificial Sequence
  Synthetic Oligonucleotide
aagctgtaaacatgagccgcacca

SEQ ID NO: 1488 - DNA, 18 bp, Artificial Sequence
  Synthetic Oligonucleotide
agctgccagtgctatccg

SEQ ID NO: 1489 - DNA, 19 bp, Artificial Sequence
  Synthetic Oligonucleotide
ctgccgggatggcttctat

SEQ ID NO: 1490 - DNA, 21 bp, Artificial Sequence
  Synthetic Oligonucleotide
ctgagctctgcccggaccgct

SEQ ID NO: 1491 - DNA, 22 bp, Artificial Sequence
  Synthetic Oligonucleotide
ccaggttctggaaactgtggat

SEQ ID NO: 1492 - DNA, 22 bp, Artificial Sequence
  Synthetic Oligonucleotide
ccaaggaatcatgttcgttcag

SEQ ID NO: 1493 - DNA, 22 bp, Artificial Sequence
  Synthetic Oligonucleotide
tggccagcagcctctcgtccac

SEQ ID NO: 1494 - DNA, 20 bp, Artificial Sequence
  Synthetic Oligonucleotide
tggtgctcgggagtcagact

SEQ ID NO: 1495 - DNA, 20 bp, Artificial Sequence
  Synthetic Oligonucleotide
gagagagtgagcgaaccctg

SEQ ID NO: 1496 - DNA, 24 bp, Artificial Sequence
  Synthetic Oligonucleotide
ccaggctccaagaagcagctgaag

SEQ ID NO: 1497 - DNA, 18 bp, Artificial Sequence
  Synthetic Oligonucleotide
cgtcgcactggagctctt

SEQ ID NO: 1498 - DNA, 21 bp, Artificial Sequence
  Synthetic Oligonucleotide
ggctgctggtacaaatactgc

SEQ ID NO: 1499 - DNA, 29 bp, Artificial Sequence
  Synthetic Oligonucleotide
tgtctgcccctattattggtgtcatttct

SEQ ID NO: 1500 - DNA, 20 bp, Artificial Sequence
  Synthetic Oligonucleotide
caatctaagccacgctgttg

SEQ ID NO: 1501 - DNA, 20 bp, Artificial Sequence
  Synthetic Oligonucleotide
tgatccatctctaggccaca

SEQ ID NO: 1502 - DNA, 24 bp, Artificial Sequence
  Synthetic Oligonucleotide
ttgtcaccttagttgcccgggttc

SEQ ID NO: 1503 - DNA, 20 bp, Artificial Sequence
  Synthetic Oligonucleotide
gagcaaatgggttgacacaa

SEQ ID NO: 1504 - DNA, 19 bp, Artificial Sequence
  Synthetic Oligonucleotide
ccaaccctgcagactccaa

SEQ ID NO: 1505 - DNA, 25 bp, Artificial Sequence
  Synthetic Oligonucleotide
cctgggaccatccgtggagacttct

SEQ ID NO: 1506 - DNA, 28 bp, Artificial Sequence
  Synthetic Oligonucleotide
atgtataatgttcctgccaacttgtatg

SEQ ID NO: 1507 - DNA, 18 bp, Artificial Sequence
  Synthetic Oligonucleotide
atctccgcctcgctcatg

SEQ ID NO: 1508 - DNA, 22 bp, Artificial Sequence
  Synthetic Oligonucleotide
ttcactcgcttcgccatcaccg

SEQ ID NO: 1509 - DNA, 21 bp, Artificial Sequence
  Synthetic Oligonucleotide
tcggagccatacaggattgtc

SEQ ID NO: 1510 - DNA, 20 bp, Artificial Sequence
  Synthetic Oligonucleotide
cgggtccaccagtttgaatg

SEQ ID NO: 1511 - DNA, 19 bp, Artificial Sequence
  Synthetic Oligonucleotide
ccgctctgcagccgggaca

SEQ ID NO: 1512 - DNA, 21 bp, Artificial Sequence
  Synthetic Oligonucleotide
gttgtattggttcggcaccat

SEQ ID NO: 1513 - DNA, 20 bp, Artificial Sequence
  Synthetic Oligonucleotide
cacttccctgctgggattat

SEQ ID NO: 1514 - DNA, 24 bp, Artificial Sequence
  Synthetic Oligonucleotide
ccgtgttgcacagctcatcacact

SEQ ID NO: 1515 - DNA, 20 bp, Artificial Sequence
  Synthetic Oligonucleotide
agttgtcaaacaggcactcg

SEQ ID NO: 1516 - DNA, 22 bp, Artificial Sequence
  Synthetic Oligonucleotide
aatgttgtccaggttctattgc

SEQ ID NO: 1517 - DNA, 28 bp, Artificial Sequence
  Synthetic Oligonucleotide
aacaggcattttggacaacacattcttg

SEQ ID NO: 1518 - DNA, 19 bp, Artificial Sequence
  Synthetic Oligonucleotide
caagcaaagggtggagttc

SEQ ID NO: 1519 - DNA, 21 bp, Artificial Sequence
  Synthetic Oligonucleotide
cacagcttgcttgtcgatgtc

SEQ ID NO: 1520 - DNA, 21 bp, Artificial Sequence
  Synthetic Oligonucleotide
ccttcgcctgcctctctgccc

SEQ ID NO: 1521 - DNA, 18 bp, Artificial Sequence
  Synthetic Oligonucleotide
atgccggtcggtgatgag

SEQ ID NO: 1522 - DNA, 27 bp, Artificial Sequence
  Synthetic Oligonucleotide
cgagactctcctcatagtgaaaggtat

SEQ ID NO: 1523 - DNA, 24 bp, Artificial Sequence
  Synthetic Oligonucleotide
atgaccaccccggctcgtatgtca

SEQ ID NO: 1524 - DNA, 22 bp, Artificial Sequence
  Synthetic Oligonucleotide
cttggcgtgtggaaatctacag

SEQ ID NO: 1525 - DNA, 20 bp, Artificial Sequence
  Synthetic Oligonucleotide
cagctctctccacgcgattc

SEQ ID NO: 1526 - DNA, 28 bp, Artificial Sequence
  Synthetic Oligonucleotide
caggatctaccccgagagagccactcat

SEQ ID NO: 1527 - DNA, 19 bp, Artificial Sequence
  Synthetic Oligonucleotide
cccagcagctccattctga

SEQ ID NO: 1528 - DNA, 20 bp, Artificial Sequence
  Synthetic Oligonucleotide
ctacagcctaaacggcaagg

SEQ ID NO: 1529 - DNA, 20 bp, Artificial Sequence
  Synthetic Oligonucleotide
aggaccccaggacccagcag

SEQ ID NO: 1530 - DNA, 20 bp, Artificial Sequence
  Synthetic Oligonucleotide
gttcccttcgaacagctttg

SEQ ID NO: 1531 - DNA, 20 bp, Artificial Sequence
  Synthetic Oligonucleotide
agaaggactatgccgtccag

SEQ ID NO: 1532 - DNA, 24 bp, Artificial Sequence
  Synthetic Oligonucleotide
atccacatcctgaaggcggacaag

SEQ ID NO: 1533 - DNA, 19 bp, Artificial Sequence
  Synthetic Oligonucleotide
ccgtgaacttccaccagtc

SEQ ID NO: 1534 - DNA, 20 bp, Artificial Sequence
  Synthetic Oligonucleotide
gcttccacatcgtggtattg

SEQ ID NO: 1535 - DNA, 27 bp, Artificial Sequence
  Synthetic Oligonucleotide
cttctgataggtttcctcggcatcaga

SEQ ID NO: 1536 - DNA, 20 bp, Artificial Sequence
  Synthetic Oligonucleotide
aactgcagggttgaaggact

SEQ ID NO: 1537 - DNA, 21 bp, Artificial Sequence
  Synthetic Oligonucleotide
agagatcaccggcgtaatcaa

SEQ ID NO: 1538 - DNA, 27 bp, Artificial Sequence
  Synthetic Oligonucleotide
ccagcgttggacaaatactttccgtca

SEQ ID NO: 1539 - DNA, 21 bp, Artificial Sequence
  Synthetic Oligonucleotide
cgggctcagctatgattctca

SEQ ID NO: 1540 - DNA, 23 bp, Artificial Sequence
  Synthetic Oligonucleotide
caaccgaagttttcactccagtt

SEQ ID NO: 1541 - DNA, 28 bp, Artificial Sequence
  Synthetic Oligonucleotide
tccccacagtagacacatatgatggccg

SEQ ID NO: 1542 - DNA, 25 bp, Artificial Sequence
  Synthetic Oligonucleotide
cctcagtccataaaccacactatca

SEQ ID NO: 1543 - DNA, 19 bp, Artificial Sequence
  Synthetic Oligonucleotide
tccttgaccataccggagg

SEQ ID NO: 1544 - DNA, 24 bp, Artificial Sequence
  Synthetic Oligonucleotide
tgcatgtacatctccggtgtccct

SEQ ID NO: 1545 - DNA, 20 bp, Artificial Sequence
  Synthetic Oligonucleotide
cagtggcagtcttccctgtc

SEQ ID NO: 1546 - DNA, 20 bp, Artificial Sequence
  Synthetic Oligonucleotide
gtttctgaaggggaggtcac

SEQ ID NO: 1547 - DNA, 24 bp, Artificial Sequence
  Synthetic Oligonucleotide
ctgagctggcctcctatgcctcat

SEQ ID NO: 1548 - DNA, 19 bp, Artificial Sequence
  Synthetic Oligonucleotide
aggtgtctggtttgggaca

SEQ ID NO: 1549 - DNA, 20 bp, Artificial Sequence
  Synthetic Oligonucleotide
gctcatcatggtcatgtgct

SEQ ID NO: 1550 - DNA, 28 bp, Artificial Sequence
  Synthetic Oligonucleotide
caggtctccttgatccactgacttttca

SEQ ID NO: 1551 - DNA, 20 bp, Artificial Sequence
  Synthetic Oligonucleotide
tgtaagggtcagggatgtca

SEQ ID NO: 1552 - DNA, 19 bp, Artificial Sequence
  Synthetic Oligonucleotide
ccctcgtgctgatgctact

SEQ ID NO: 1553 - DNA, 22 bp, Artificial Sequence
  Synthetic Oligonucleotide
ctgccctagacgctggctcctc

SEQ ID NO: 1554 - DNA, 22 bp, Artificial Sequence
  Synthetic Oligonucleotide
catcatgacctggtcttctagg

SEQ ID NO: 1555 - DNA, 19 bp, Artificial Sequence
  Synthetic Oligonucleotide
gcggaaggtccctcagaca

SEQ ID NO: 1556 - DNA, 29 bp, Artificial Sequence
  Synthetic Oligonucleotide
ctcagagcctctctggttctttcaatcgg

SEQ ID NO: 1557 - DNA, 24 bp, Artificial Sequence
  Synthetic Oligonucleotide
tgatgatctaagtttcccgaggtt

SEQ ID NO: 1558 - DNA, 21 bp, Artificial Sequence
  Synthetic Oligonucleotide
tggagactctcagggtcgaaa

SEQ ID NO: 1559 - DNA, 20 bp, Artificial Sequence
  Synthetic Oligonucleotide
cggcggcagaccagcatgac

SEQ ID NO: 1560 - DNA, 22 bp, Artificial Sequence
  Synthetic Oligonucleotide
ggcgtttggagtggtagaaatc

SEQ ID NO: 1561 - DNA, 21 bp, Artificial Sequence
  Synthetic Oligonucleotide
cggtggaccacgaagagttaa

SEQ ID NO: 1562 - DNA, 23 bp, Artificial Sequence
  Synthetic Oligonucleotide
ccgggacttggagaagcactgca

SEQ ID NO: 1563 - DNA, 19 bp, Artificial Sequence
  Synthetic Oligonucleotide
ggctcgcctcttccatgtc

SEQ ID NO: 1564 - DNA, 20 bp, Artificial Sequence
  Synthetic Oligonucleotide
ctttgaacccttgcttgcaa

SEQ ID NO: 1565 - DNA, 25 bp, Artificial Sequence
  Synthetic Oligonucleotide
aagtcctgggtgcttctgacgcaca

SEQ ID NO: 1566 - DNA, 18 bp, Artificial Sequence
  Synthetic Oligonucleotide
cccgggacaaagcaaatg

SEQ ID NO: 1567 - DNA, 20 bp, Artificial Sequence
  Synthetic Oligonucleotide
cccagctagtgttcctcaga

SEQ ID NO: 1568 - DNA, 24 bp, Artificial Sequence
  Synthetic Oligonucleotide
tcggccagctttttccaatctttg

SEQ ID NO: 1569 - DNA, 20 bp, Artificial Sequence
  Synthetic Oligonucleotide
ccgtaagcccttcctctatg

SEQ ID NO: 1570 - DNA, 20 bp, Artificial Sequence
  Synthetic Oligonucleotide
agcagtggcttgctttcttc

SEQ ID NO: 1571 - DNA, 25 bp, Artificial Sequence
  Synthetic Oligonucleotide
cctgtgatgtcccagtttcccactc

SEQ ID NO: 1572 - DNA, 20 bp, Artificial Sequence
  Synthetic Oligonucleotide
tgctaggaccatgttgggat

SEQ ID NO: 1573 - DNA, 19 bp, Artificial Sequence
  Synthetic Oligonucleotide
ccgcaacgtggttttctca

SEQ ID NO: 1574 - DNA, 22 bp, Artificial Sequence
  Synthetic Oligonucleotide
ctcggtgttggccatgctccag

SEQ ID NO: 1575 - DNA, 21 bp, Artificial Sequence
  Synthetic Oligonucleotide
tgctgggtttctcctcctgtt

SEQ ID NO: 1576 - DNA, 20 bp, Artificial Sequence
  Synthetic Oligonucleotide
gagctgtgggttgttatgga

SEQ ID NO: 1577 - DNA, 24 bp, Artificial Sequence
  Synthetic Oligonucleotide
acatctgtcaaggagcctccagcc

SEQ ID NO: 1578 - DNA, 20 bp, Artificial Sequence
  Synthetic Oligonucleotide
ccatgcaagtttctgtcacc

SEQ ID NO: 1579 - DNA, 20 bp, Artificial Sequence
  Synthetic Oligonucleotide
ggagctgacctgcttcctac

SEQ ID NO: 1580 - DNA, 22 bp, Artificial Sequence
  Synthetic Oligonucleotide
tccttatgcatcgaggccaggc

SEQ ID NO: 1581 - DNA, 20 bp, Artificial Sequence
  Synthetic Oligonucleotide
agcagagcaccacagcatag

SEQ ID NO: 1582 - DNA, 20 bp, Artificial Sequence
  Synthetic Oligonucleotide
aggtggctgtgttactgcaa

SEQ ID NO: 1583 - DNA, 25 bp, Artificial Sequence
  Synthetic Oligonucleotide
tgccacagttctgcgacagtctacc

SEQ ID NO: 1584 - DNA, 20 bp, Artificial Sequence
  Synthetic Oligonucleotide
cacctgtgtggtttcgtacc

SEQ ID NO: 1585 - DNA, 22 bp, Artificial Sequence
  Synthetic Oligonucleotide
gaaggtgttggaggcactcaag

SEQ ID NO: 1586 - DNA, 24 bp, Artificial Sequence
  Synthetic Oligonucleotide
atcccagcaggcctcgttgatgag

SEQ ID NO: 1587 - DNA, 21 bp, Artificial Sequence
  Synthetic Oligonucleotide
ggtttacaccgctggagctaa

SEQ ID NO: 1588 - DNA, 19 bp, Artificial Sequence
  Synthetic Oligonucleotide
ttgttggtgtgccctggtg

SEQ ID NO: 1589 - DNA, 22 bp, Artificial Sequence
  Synthetic Oligonucleotide
tggtggcggtcactccctctgc

SEQ ID NO: 1590 - DNA, 21 bp, Artificial Sequence
  Synthetic Oligonucleotide
tgggttctgtccaaacactgg

SEQ ID NO: 1591 - DNA, 20 bp, Artificial Sequence
  Synthetic Oligonucleotide
actgaaggagacccttggag

SEQ ID NO: 1592 - DNA, 21 bp, Artificial Sequence
  Synthetic Oligonucleotide
tctcctgccgatgcccctagg

SEQ ID NO: 1593 - DNA, 20 bp, Artificial Sequence
  Synthetic Oligonucleotide
taaataaccctgcccacaca

SEQ ID NO: 1594 - DNA, 28 bp, Artificial Sequence
  Synthetic Oligonucleotide
agttactaaaaaataccacgaggtcctt

SEQ ID NO: 1595 - DNA, 27 bp, Artificial Sequence
  Synthetic Oligonucleotide
ccctgacaccggtctttggtctcaact

SEQ ID NO: 1596 - DNA, 21 bp, Artificial Sequence
  Synthetic Oligonucleotide
gtcggtgagtgatttgtgcaa

SEQ ID NO: 1597 - DNA, 20 bp, Artificial Sequence
  Synthetic Oligonucleotide
tatcgaggcaggtcatacca

SEQ ID NO: 1598 - DNA, 25 bp, Artificial Sequence
  Synthetic Oligonucleotide
tccaggtcaacttttgacttccggt

SEQ ID NO: 1599 - DNA, 20 bp, Artificial Sequence
  Synthetic Oligonucleotide
taacgcttggcatcatcatt

SEQ ID NO: 1600 - DNA, 20 bp, Artificial Sequence
  Synthetic Oligonucleotide
gggagtttccaagagatgga

SEQ ID NO: 1601 - DNA, 23 bp, Artificial Sequence
  Synthetic Oligonucleotide
cccaagacccgaccaagcactag

SEQ ID NO: 1602 - DNA, 20 bp, Artificial Sequence
  Synthetic Oligonucleotide
cttcaaccaccttcccaaac

SEQ ID NO: 1603 - DNA, 20 bp, Artificial Sequence
  Synthetic Oligonucleotide
ccagctctccttccagctac

SEQ ID NO: 1604 - DNA, 24 bp, Artificial Sequence
  Synthetic Oligonucleotide
atcaatgtccctgtccgagtgctg

SEQ ID NO: 1605 - DNA, 20 bp, Artificial Sequence
  Synthetic Oligonucleotide
gggtggctctcacttagctc

SEQ ID NO: 1606 - DNA, 20 bp, Artificial Sequence
  Synthetic Oligonucleotide
ggaaaacgttcgtcaacatc

SEQ ID NO: 1607 - DNA, 23 bp, Artificial Sequence
  Synthetic Oligonucleotide
caaccaggacacccacctcagct

SEQ ID NO: 1608 - DNA, 20 bp, Artificial Sequence
  Synthetic Oligonucleotide
aaaacttgaccggtctttgc

SEQ ID NO: 1609 - DNA, 22 bp, Artificial Sequence
  Synthetic Oligonucleotide
tctatacgtcgatggtgactgc

SEQ ID NO: 1610 - DNA, 24 bp, Artificial Sequence
  Synthetic Oligonucleotide
ctccccaccttgactctttgtccg

SEQ ID NO: 1611 - DNA, 19 bp, Artificial Sequence
  Synthetic Oligonucleotide
gccgacagccacattgtat

SEQ ID NO: 1612 - DNA, 24 bp, Artificial Sequence
  Synthetic Oligonucleotide
agagccagttgctgtagaactcaa

SEQ ID NO: 1613 - DNA, 27 bp, Artificial Sequence
  Synthetic Oligonucleotide
tctctgctgggcaaggatgttctgttc

SEQ ID NO: 1614 - DNA, 21 bp, Artificial Sequence
  Synthetic Oligonucleotide
ctgggcctacacagtccttca

SEQ ID NO: 1615 - DNA, 18 bp, Artificial Sequence
  Synthetic Oligonucleotide
tgctacctggacagcccg

SEQ ID NO: 1616 - DNA, 28 bp, Artificial Sequence
  Synthetic Oligonucleotide
tcctcctgaaacgagctgtgtctgactt

SEQ ID NO: 1617 - DNA, 20 bp, Artificial Sequence
  Synthetic Oligonucleotide
aggccgtccttcagtaacca

SEQ ID NO: 1618 - DNA, 21 bp, Artificial Sequence
  Synthetic Oligonucleotide
ataccaatcaccgcacaaacc

SEQ ID NO: 1619 - DNA, 30 bp, Artificial Sequence
  Synthetic Oligonucleotide
tgcgctgtgactggacttaacaaatagcct

SEQ ID NO: 1620 - DNA, 23 bp, Artificial Sequence
  Synthetic Oligonucleotide
cacactagcattttctccgcata

SEQ ID NO: 1621 - DNA, 20 bp, Artificial Sequence
  Synthetic Oligonucleotide
gtgattgaagagcatgccaa

SEQ ID NO: 1622 - DNA, 24 bp, Artificial Sequence
  Synthetic Oligonucleotide
tcctgcttctcgggatacagacca

SEQ ID NO: 1623 - DNA, 18 bp, Artificial Sequence
  Synthetic Oligonucleotide
gtcctgcgtgggaatagc

SEQ ID NO: 1624 - DNA, 20 bp, Artificial Sequence
  Synthetic Oligonucleotide
ctgctcaaggacaccgtcta

SEQ ID NO: 1625 - DNA, 24 bp, Artificial Sequence
  Synthetic Oligonucleotide
tacactcgggtcccatcgaagtcc

SEQ ID NO: 1626 - DNA, 18 bp, Artificial Sequence
  Synthetic Oligonucleotide
ggatccactctggagggc

SEQ ID NO: 1627 - DNA, 20 bp, Artificial Sequence
  Synthetic Oligonucleotide
gatcaacggctacatccaga

SEQ ID NO: 1628 - DNA, 25 bp, Artificial Sequence
  Synthetic Oligonucleotide
tcaaagtcctcctctcccgacttga

SEQ ID NO: 1629 - DNA, 20 bp, Artificial Sequence
  Synthetic Oligonucleotide
tgaactgtgaggccagagac

SEQ ID NO: 1630 - DNA, 19 bp, Artificial Sequence
  Synthetic Oligonucleotide
cagcaccagcgattacgac

SEQ ID NO: 1631 - DNA, 24 bp, Artificial Sequence
  Synthetic Oligonucleotide
agccattgtgaggactctcccagc

SEQ ID NO: 1632 - DNA, 18 bp, Artificial Sequence
  Synthetic Oligonucleotide
ctgaataggcccacgtcc

SEQ ID NO: 1633 - DNA, 20 bp, Artificial Sequence
  Synthetic Oligonucleotide
ccgcctggacattgattcac

SEQ ID NO: 1634 - DNA, 23 bp, Artificial Sequence
  Synthetic Oligonucleotide
acccatcacagcccggaacactg

SEQ ID NO: 1635 - DNA, 21 bp, Artificial Sequence
  Synthetic Oligonucleotide
ctgggccaatggtacagatga

SEQ ID NO: 1636 - DNA, 19 bp, Artificial Sequence
  Synthetic Oligonucleotide
gcatccctcacccatccta

SEQ ID NO: 1637 - DNA, 24 bp, Artificial Sequence
  Synthetic Oligonucleotide
aggccaggcaggagcccttctata

SEQ ID NO: 1638 - DNA, 20 bp, Artificial Sequence
  Synthetic Oligonucleotide
gctggaaatctgctggatgt

SEQ ID NO: 1639 - DNA, 20 bp, Artificial Sequence
  Synthetic Oligonucleotide
cccatggatgctcctctgaa

SEQ ID NO: 1640 - DNA, 22 bp, Artificial Sequence
  Synthetic Oligonucleotide
cattgactgccgaggccccatg

SEQ ID NO: 1641 - DNA, 20 bp, Artificial Sequence
  Synthetic Oligonucleotide
ccggtggctaccagacattg

SEQ ID NO: 1642 - DNA, 26 bp, Artificial Sequence
  Synthetic Oligonucleotide
aatgaatacagtattcccaagcacat

SEQ ID NO: 1643 - DNA, 18 bp, Artificial Sequence
  Synthetic Oligonucleotide
aaccccgtggccgcctcc

SEQ ID NO: 1644 - DNA, 23 bp, Artificial Sequence
  Synthetic Oligonucleotide
tgtctgaagcatcttctggatga

SEQ ID NO: 1645 - DNA, 19 bp, Artificial Sequence
  Synthetic Oligonucleotide
tgaaggagacgtaccgctg

SEQ ID NO: 1646 - DNA, 24 bp, Artificial Sequence
  Synthetic Oligonucleotide
caagcaggttcactacacgctgcc

SEQ ID NO: 1647 - DNA, 18 bp, Artificial Sequence
  Synthetic Oligonucleotide
caggcagtgagaggctgg

SEQ ID NO: 1648 - DNA, 19 bp, Artificial Sequence
  Synthetic Oligonucleotide
cagggaggtggttgcaaat

SEQ ID NO: 1649 - DNA, 24 bp, Artificial Sequence
  Synthetic Oligonucleotide
tccagccttttcgtggtgactcaa

SEQ ID NO: 1650 - DNA, 19 bp, Artificial Sequence
  Synthetic Oligonucleotide
tctcccaggatgcatgaag

SEQ ID NO: 1651 - DNA, 21 bp, Artificial Sequence
  Synthetic Oligonucleotide
cttacggttttcgtggagaag

SEQ ID NO: 1652 - DNA, 29 bp, Artificial Sequence
  Synthetic Oligonucleotide
cctcagctatacaacaaattgaccccaag

SEQ ID NO: 1653 - DNA, 20 bp, Artificial Sequence
  Synthetic Oligonucleotide
agcagccgttcttgttgtaa

SEQ ID NO: 1654 - DNA, 20 bp, Artificial Sequence
  Synthetic Oligonucleotide
gatgtggactgccattcaaa

SEQ ID NO: 1655 - DNA, 28 bp, Artificial Sequence
  Synthetic Oligonucleotide
tcgaaatttacatccggtatcttcctgg

SEQ ID NO: 1656 - DNA, 20 bp, Artificial Sequence
  Synthetic Oligonucleotide
tgcgagattagttggctgag

SEQ ID NO: 1657 - DNA, 21 bp, Artificial Sequence
  Synthetic Oligonucleotide
tgactttatggagcccaagtt

SEQ ID NO: 1658 - DNA, 25 bp, Artificial Sequence
  Synthetic Oligonucleotide
ttccagtgcattgaacttcacagca

SEQ ID NO: 1659 - DNA, 20 bp, Artificial Sequence
  Synthetic Oligonucleotide
gccaagtcgctgtcatctaa

SEQ ID NO: 1660 - DNA, 20 bp, Artificial Sequence
  Synthetic Oligonucleotide
tcctcatttggatgggaaac

SEQ ID NO: 1661 - DNA, 29 bp, Artificial Sequence
  Synthetic Oligonucleotide
ttcctttaattacttggccaaacaccaca

SEQ ID NO: 1662 - DNA, 21 bp, Artificial Sequence
  Synthetic Oligonucleotide
ccaatatccttgccactccta

SEQ ID NO: 1663 - DNA, 18 bp, Artificial Sequence
  Synthetic Oligonucleotide
gccatccgcaaaggcttt

SEQ ID NO: 1664 - DNA, 23 bp, Artificial Sequence
  Synthetic Oligonucleotide
tcgcttgtcaccttgccatgtgg

SEQ ID NO: 1665 - DNA, 18 bp, Artificial Sequence
  Synthetic Oligonucleotide
ggccattccgccagtttc

SEQ ID NO: 1666 - DNA, 20 bp, Artificial Sequence
  Synthetic Oligonucleotide
ggctcagagcataaggcttc

SEQ ID NO: 1667 - DNA, 24 bp, Artificial Sequence
  Synthetic Oligonucleotide
ttggtcacttctcccaacttgggc

SEQ ID NO: 1668 - DNA, 20 bp, Artificial Sequence
  Synthetic Oligonucleotide
acgggaactcagaaaactgg

SEQ ID NO: 1669 - DNA, 20 bp, Artificial Sequence
  Synthetic Oligonucleotide
gcatcaggctgtcattatgg

SEQ ID NO: 1670 - DNA, 28 bp, Artificial Sequence
  Synthetic Oligonucleotide
tgtccttacctgtgggagctgtaaggtc

SEQ ID NO: 1671 - DNA, 20 bp, Artificial Sequence
  Synthetic Oligonucleotide
agtagttgtgctgcccttcc

SEQ ID NO: 1672 - DNA, 20 bp, Artificial Sequence
  Synthetic Oligonucleotide
ggtgtccttcgccagatcac

SEQ ID NO: 1673 - DNA, 26 bp, Artificial Sequence
  Synthetic Oligonucleotide
ttaatgatttgcctgtgggacgctcc

SEQ ID NO: 1674 - DNA, 18 bp, Artificial Sequence
  Synthetic Oligonucleotide
cagccgcagagcctcatc

SEQ ID NO: 1675 - DNA, 20 bp, Artificial Sequence
  Synthetic Oligonucleotide
tgaccccaatggagtcatca

SEQ ID NO: 1676 - DNA, 27 bp, Artificial Sequence
  Synthetic Oligonucleotide
catttgagcgtcaacgatctcccagtg

SEQ ID NO: 1677 - DNA, 19 bp, Artificial Sequence
  Synthetic Oligonucleotide
ccaagcggagggtttcttc

SEQ ID NO: 1678 - DNA, 22 bp, Artificial Sequence
  Synthetic Oligonucleotide
ttacccatttggcctggattaa

SEQ ID NO: 1679 - DNA, 26 bp, Artificial Sequence
  Synthetic Oligonucleotide
ccaagtcctccttgtcttcgaggggt

SEQ ID NO: 1680 - DNA, 25 bp, Artificial Sequence
  Synthetic Oligonucleotide
ctgaaagaagtggaatccttattgg

SEQ ID NO: 1681 - DNA, 20 bp, Artificial Sequence
  Synthetic Oligonucleotide
ctgtgagccagaggatgtca

SEQ ID NO: 1682 - DNA, 24 bp, Artificial Sequence
  Synthetic Oligonucleotide
ctgccaattgtgttttcctgcagc

SEQ ID NO: 1683 - DNA, 20 bp, Artificial Sequence
  Synthetic Oligonucleotide
tgtgatgacaccaggatgtg

SEQ ID NO: 1684 - DNA, 21 bp, Artificial Sequence
  Synthetic Oligonucleotide
caagcaatgcgtcatcaatgt

SEQ ID NO: 1685 - DNA, 25 bp, Artificial Sequence
  Synthetic Oligonucleotide
cagcctctgcggaatggatcacact

SEQ ID NO: 1686 - DNA, 20 bp, Artificial Sequence
  Synthetic Oligonucleotide
gtaaatccgccccctcttct

SEQ ID NO: 1687 - DNA, 18 bp, Artificial Sequence
  Synthetic Oligonucleotide
gacccagctccactcctg

SEQ ID NO: 1688 - DNA, 24 bp, Artificial Sequence
  Synthetic Oligonucleotide
ccagaccatggaccgcctgtactt

SEQ ID NO: 1689 - DNA, 20 bp, Artificial Sequence
  Synthetic Oligonucleotide
cccattcacgtactccatca

SEQ ID NO: 1690 - DNA, 20 bp, Artificial Sequence
  Synthetic Oligonucleotide
ctgacacttgccgcagagaa

SEQ ID NO: 1691 - DNA, 26 bp, Artificial Sequence
  Synthetic Oligonucleotide
ccctttctcacccacctcatctgcac

SEQ ID NO: 1692 - DNA, 20 bp, Artificial Sequence
  Synthetic Oligonucleotide
aggtggtccttggtctggaa

SEQ ID NO: 1693 - DNA, 21 bp, Artificial Sequence
  Synthetic Oligonucleotide
gcgatacatgagcccagaaca

SEQ ID NO: 1694 - DNA, 29 bp, Artificial Sequence
  Synthetic Oligonucleotide
aggtccacttcctttccatagtcttgcga

SEQ ID NO: 1695 - DNA, 22 bp, Artificial Sequence
  Synthetic Oligonucleotide
tcagcaagaattagccccaaag

SEQ ID NO: 1696 - DNA, 19 bp, Artificial Sequence
  Synthetic Oligonucleotide
gccctcccagtgtgcaaat

SEQ ID NO: 1697 - DNA, 23 bp, Artificial Sequence
  Synthetic Oligonucleotide
tgctgtttcgacgacaccgttcg

SEQ ID NO: 1698 - DNA, 25 bp, Artificial Sequence
  Synthetic Oligonucleotide
cgtcgatggtattaggatagaagca

SEQ ID NO: 1699 - DNA, 19 bp, Artificial Sequence
  Synthetic Oligonucleotide
ccacgacaaagccgactac

SEQ ID NO: 1700 - DNA, 24 bp, Artificial Sequence
  Synthetic Oligonucleotide
cctgaaacaaggctgagaatcccg

SEQ ID NO: 1701 - DNA, 19 bp, Artificial Sequence
  Synthetic Oligonucleotide
tactcgatgggctctgctg

SEQ ID NO: 1702 - DNA, 25 bp, Artificial Sequence
  Synthetic Oligonucleotide
tggctaagtgaagatgacaatcatg

SEQ ID NO: 1703 - DNA, 29 bp, Artificial Sequence
  Synthetic Oligonucleotide
cctttccagctttacagtgaattgctgca

SEQ ID NO: 1704 - DNA, 25 bp, Artificial Sequence
  Synthetic Oligonucleotide
tgcacatatcattacaccagttcgt

SEQ ID NO: 1705 - DNA, 20 bp, Artificial Sequence
  Synthetic Oligonucleotide
taactggggcaaccttttct

SEQ ID NO: 1706 - DNA, 22 bp, Artificial Sequence
  Synthetic Oligonucleotide
cctttgccttcctggggctctt

SEQ ID NO: 1707 - DNA, 20 bp, Artificial Sequence
  Synthetic Oligonucleotide
ttgcaggaaaaggtgactgt

SEQ ID NO: 1708 - DNA, 22 bp, Artificial Sequence
  Synthetic Oligonucleotide
agtgactgggagtgggctagaa

SEQ ID NO: 1709 - DNA, 24 bp, Artificial Sequence
  Synthetic Oligonucleotide
tgacacctccacaacgtcgctgga

SEQ ID NO: 1710 - DNA, 21 bp, Artificial Sequence
  Synthetic Oligonucleotide
aagcctgttaccgtgaatcga

SEQ ID NO: 1711 - DNA, 24 bp, Artificial Sequence
  Synthetic Oligonucleotide
cgaggtacaagctgagatcaagaa

SEQ ID NO: 1712 - DNA, 22 bp, Artificial Sequence
  Synthetic Oligonucleotide
ccagtgccagtgtccagcggct

SEQ ID NO: 1713 - DNA, 18 bp, Artificial Sequence
  Synthetic Oligonucleotide
gcgtgcctttcgcttgaa

SEQ ID NO: 1714 - DNA, 20 bp, Artificial Sequence
  Synthetic Oligonucleotide
gaccggtcgaatgataaggt

SEQ ID NO: 1715 - DNA, 24 bp, Artificial Sequence
  Synthetic Oligonucleotide
accaggcccgtcacattctcgtac

SEQ ID NO: 1716 - DNA, 20 bp, Artificial Sequence
  Synthetic Oligonucleotide
ctggacatctcgatgacagc

SEQ ID NO: 1717 - DNA, 19 bp, Artificial Sequence
  Synthetic Oligonucleotide
caagcccagccgacctaag

SEQ ID NO: 1718 - DNA, 23 bp, Artificial Sequence
  Synthetic Oligonucleotide
ctccgcaaaccaacctcctggct

SEQ ID NO: 1719 - DNA, 21 bp, Artificial Sequence
  Synthetic Oligonucleotide
gaacctggaactgcagctttg

SEQ ID NO: 1720 - DNA, 20 bp, Artificial Sequence
  Synthetic Oligonucleotide
cctgttctcggcaccttaaa

SEQ ID NO: 1721 - DNA, 24 bp, Artificial Sequence
  Synthetic Oligonucleotide
acctgactgccccggggtctaata

SEQ ID NO: 1722 - DNA, 18 bp, Artificial Sequence
  Synthetic Oligonucleotide
tattgccttcgggtgtcc

SEQ ID NO: 1723 - DNA, 20 bp, Artificial Sequence
  Synthetic Oligonucleotide
aatatttgtgcggggtatgg

SEQ ID NO: 1724 - DNA, 29 bp, Artificial Sequence
  Synthetic Oligonucleotide
ccaagagaaacgagatttaaaaacccacc

SEQ ID NO: 1725 - DNA, 20 bp, Artificial Sequence
  Synthetic Oligonucleotide
aacgagatccctgtgcttgt

SEQ ID NO: 1726 - DNA, 23 bp, Artificial Sequence
  Synthetic Oligonucleotide
cgcttgcctaactcatactttcc

SEQ ID NO: 1727 - DNA, 19 bp, Artificial Sequence
  Synthetic Oligonucleotide
tccacgcagcgtggcactg

SEQ ID NO: 1728 - DNA, 20 bp, Artificial Sequence
  Synthetic Oligonucleotide
ccattcagactgcgccactt

SEQ ID NO: 1729 - DNA, 20 bp, Artificial Sequence
  Synthetic Oligonucleotide
aatgaggaagtttcggatgg

SEQ ID NO: 1730 - DNA, 23 bp, Artificial Sequence
  Synthetic Oligonucleotide
ctgatccagacagccgaccagct

SEQ ID NO: 1731 - DNA, 20 bp, Artificial Sequence
  Synthetic Oligonucleotide
cttcgatcacagccaggtag

SEQ ID NO: 1732 - DNA, 20 bp, Artificial Sequence
  Synthetic Oligonucleotide
tgttttagctgagggacgtg

SEQ ID NO: 1733 - DNA, 24 bp, Artificial Sequence
  Synthetic Oligonucleotide
ccgacgtccccaaacctagctagg

SEQ ID NO: 1734 - DNA, 20 bp, Artificial Sequence
  Synthetic Oligonucleotide
taccaaccctggaatgttga

SEQ ID NO: 1735 - DNA, 21 bp, Artificial Sequence
  Synthetic Oligonucleotide
aacttccggtacctcgttcgt

SEQ ID NO: 1736 - DNA, 29 bp, Artificial Sequence
  Synthetic Oligonucleotide
actacatgaagcagagtcctcccgaatcg

SEQ ID NO: 1737 - DNA, 20 bp, Artificial Sequence
  Synthetic Oligonucleotide
agcactgcaatgcaccagaa

SEQ ID NO: 1738 - DNA, 19 bp, Artificial Sequence
  Synthetic Oligonucleotide
catggcctgatcatggtgt

SEQ ID NO: 1739 - DNA, 24 bp, Artificial Sequence
  Synthetic Oligonucleotide
cccacagcaaatgctgcagaaagt

SEQ ID NO: 1740 - DNA, 21 bp, Artificial Sequence
  Synthetic Oligonucleotide
ccatgtgtacaaactgcagga

SEQ ID NO: 1741 - DNA, 28 bp, Artificial Sequence
  Synthetic Oligonucleotide
ggctactctgatctatgttgataaggaa

SEQ ID NO: 1742 - DNA, 22 bp, Artificial Sequence
  Synthetic Oligonucleotide
cacacgggtgcctggttctcca

SEQ ID NO: 1743 - DNA, 20 bp, Artificial Sequence
  Synthetic Oligonucleotide
gcttcagcccatccttagca

SEQ ID NO: 1744 - DNA, 18 bp, Artificial Sequence
  Synthetic Oligonucleotide
cctgcagctgtgggacat

SEQ ID NO: 1745 - DNA, 24 bp, Artificial Sequence
  Synthetic Oligonucleotide
cgatttggcaacatgacccgagta

SEQ ID NO: 1746 - DNA, 19 bp, Artificial Sequence
  Synthetic Oligonucleotide
agcaccaacagcttccttg

SEQ ID NO: 1747 - DNA, 21 bp, Artificial Sequence
  Synthetic Oligonucleotide
gcgacagctcctctagttcca

SEQ ID NO: 1748 - DNA, 19 bp, Artificial Sequence
  Synthetic Oligonucleotide
ttcccgaagtctccgcccg

SEQ ID NO: 1749 - DNA, 22 bp, Artificial Sequence
  Synthetic Oligonucleotide
ggaacaccagcttgaatttcct

SEQ ID NO: 1750 - DNA, 21 bp, Artificial Sequence
  Synthetic Oligonucleotide
tgttgtaaatgtctcagcccc

SEQ ID NO: 1751 - DNA, 23 bp, Artificial Sequence
  Synthetic Oligonucleotide
cgttcttggtcctgtcccttgga

SEQ ID NO: 1752 - DNA, 20 bp, Artificial Sequence
  Synthetic Oligonucleotide
ttgagcaaagcgtacaaagg

SEQ ID NO: 1753 - DNA, 24 bp, Artificial Sequence
  Synthetic Oligonucleotide
gaacttcttgagcaggagcatacc

SEQ ID NO: 1754 - DNA, 25 bp, Artificial Sequence
  Synthetic Oligonucleotide
agggcttcataatcaccttctgttc

SEQ ID NO: 1755 - DNA, 25 bp, Artificial Sequence
  Synthetic Oligonucleotide
tccacccccaagaatatcatctagt

SEQ ID NO: 1756 - DNA, 23 bp, Artificial Sequence
  Synthetic Oligonucleotide
agctagcctcagtgacacacatg

SEQ ID NO: 1757 - DNA, 24 bp, Artificial Sequence
  Synthetic Oligonucleotide
acacaacgtcggcagtgcaacctg

SEQ ID NO: 1758 - DNA, 18 bp, Artificial Sequence
  Synthetic Oligonucleotide
ccggatctgacggctgtt

SEQ ID NO: 1759 - DNA, 20 bp, Artificial Sequence
  Synthetic Oligonucleotide
cgtcgtatgcgagagtctgt

SEQ ID NO: 1760 - DNA, 26 bp, Artificial Sequence
  Synthetic Oligonucleotide
tccaggatgcctgttagttctcagca

SEQ ID NO: 1761 - DNA, 20 bp, Artificial Sequence
  Synthetic Oligonucleotide
tgaaggcgtgaggtgtagaa

SEQ ID NO: 1762 - DNA, 26 bp, Artificial Sequence
  Synthetic Oligonucleotide
ggtgtcagatataaatgtgcaaatgc

SEQ ID NO: 1763 - DNA, 28 bp, Artificial Sequence
  Synthetic Oligonucleotide
tgctgtcctgtcggtctcagtacgttca

SEQ ID NO: 1764 - DNA, 24 bp, Artificial Sequence
  Synthetic Oligonucleotide
ttcgatattgccagcagctataaa

SEQ ID NO: 1765 - DNA, 20 bp, Artificial Sequence
  Synthetic Oligonucleotide
tccttcagctttcacactgg

SEQ ID NO: 1766 - DNA, 29 bp, Artificial Sequence
  Synthetic Oligonucleotide
tccagaagagtcatgcaacttcatttctg

SEQ ID NO: 1767 - DNA, 20 bp, Artificial Sequence
  Synthetic Oligonucleotide
aaatcctgttcccacctgac

SEQ ID NO: 1768 - DNA, 20 bp, Artificial Sequence
  Synthetic Oligonucleotide
aacatgattatccaagccgc

SEQ ID NO: 1769 - DNA, 24 bp, Artificial Sequence
  Synthetic Oligonucleotide
aagccaattttgtccacaatggca

SEQ ID NO: 1770 - DNA, 20 bp, Artificial Sequence
  Synthetic Oligonucleotide
gccaacaagcactgttatcg

SEQ ID NO: 1771 - DNA, 22 bp, Artificial Sequence
  Synthetic Oligonucleotide
caagtcagttgagacgccagtt

SEQ ID NO: 1772 - DNA, 25 bp, Artificial Sequence
  Synthetic Oligonucleotide
ttctatggcggcctgacttcctcca

SEQ ID NO: 1773 - DNA, 20 bp, Artificial Sequence
  Synthetic Oligonucleotide
tgcagctctcgtccaaagtg

SEQ ID NO: 1774 - DNA, 20 bp, Artificial Sequence
  Synthetic Oligonucleotide
tgtggatgctggattgattt

SEQ ID NO: 1775 - DNA, 25 bp, Artificial Sequence
  Synthetic Oligonucleotide
ccactggtgcagctgctaaatagca

SEQ ID NO: 1776 - DNA, 20 bp, Artificial Sequence
  Synthetic Oligonucleotide
aagcagcacttcctggtctt

SEQ ID NO: 1777 - DNA, 23 bp, Artificial Sequence
  Synthetic Oligonucleotide
agtctgtgagaaacgaccgaaac

SEQ ID NO: 1778 - DNA, 23 bp, Artificial Sequence
  Synthetic Oligonucleotide
tcgggcttgggcacctccttctt

SEQ ID NO: 1779 - DNA, 18 bp, Artificial Sequence
  Synthetic Oligonucleotide
cggcgtcagcgtgtagct

SEQ ID NO: 1780 - DNA, 20 bp, Artificial Sequence
  Synthetic Oligonucleotide
tgcctggacatcctgattct

SEQ ID NO: 1781 - DNA, 26 bp, Artificial Sequence
  Synthetic Oligonucleotide
tgcaccaggtataccccagaacaaga

SEQ ID NO: 1782 - DNA, 20 bp, Artificial Sequence
  Synthetic Oligonucleotide
aaggccgtctgagaaagtca

SEQ ID NO: 1783 - DNA, 20 bp, Artificial Sequence
  Synthetic Oligonucleotide
agtgggagacacctgacctt

SEQ ID NO: 1784 - DNA, 29 bp, Artificial Sequence
  Synthetic Oligonucleotide
ttgatcttctgctcaatctcagcttgaga

SEQ ID NO: 1785 - DNA, 20 bp, Artificial Sequence
  Synthetic Oligonucleotide
tgatctgggcattgtactcc

SEQ ID NO: 1786 - DNA, 21 bp, Artificial Sequence
  Synthetic Oligonucleotide
cgagagggagagcaagaccat

SEQ ID NO: 1787 - DNA, 19 bp, Artificial Sequence
  Synthetic Oligonucleotide
ctgcgcggccttcccatca

SEQ ID NO: 1788 - DNA, 24 bp, Artificial Sequence
  Synthetic Oligonucleotide
tctcgaatatcgctctctgtgatg

SEQ ID NO: 1789 - DNA, 23 bp, Artificial Sequence
  Synthetic Oligonucleotide
ggaaccacattatggatctttgc

SEQ ID NO: 1790 - DNA, 28 bp, Artificial Sequence
  Synthetic Oligonucleotide
tagaatgtcaagctaaccaggcgtccgc

SEQ ID NO: 1791 - DNA, 24 bp, Artificial Sequence
  Synthetic Oligonucleotide
catgcgacagtacactcttctgaa

SEQ ID NO: 1792 - DNA, 18 bp, Artificial Sequence
  Synthetic Oligonucleotide
gggctgggtgagaatgtg

SEQ ID NO: 1793 - DNA, 24 bp, Artificial Sequence
  Synthetic Oligonucleotide
ataccagggccggcttcttcctct

SEQ ID NO: 1794 - DNA, 19 bp, Artificial Sequence
  Synthetic Oligonucleotide
cacaacatcctccggaatg

SEQ ID NO: 1795 - DNA, 19 bp, Artificial Sequence
  Synthetic Oligonucleotide
tgctaactcctgcacagcc

SEQ ID NO: 1796 - DNA, 25 bp, Artificial Sequence
  Synthetic Oligonucleotide
tcctcttcctttctgctagcctggc

SEQ ID NO: 1797 - DNA, 20 bp, Artificial Sequence
  Synthetic Oligonucleotide
tgctaggtttcccctctgaa

SEQ ID NO: 1798 - DNA, 25 bp, Artificial Sequence
  Synthetic Oligonucleotide
tcaagaccatcatcactttcattgt

SEQ ID NO: 1799 - DNA, 21 bp, Artificial Sequence
  Synthetic Oligonucleotide
cctcccggtccgcaagcagtt

SEQ ID NO: 1800 - DNA, 27 bp, Artificial Sequence
  Synthetic Oligonucleotide
ggatcaggaagtacacggagtataact

SEQ ID NO: 1801 - DNA, 21 bp, Artificial Sequence
  Synthetic Oligonucleotide
aagcatgaacaggacttgacc

SEQ ID NO: 1802 - DNA, 24 bp, Artificial Sequence
  Synthetic Oligonucleotide
ctttccaacccctggggaagacat

SEQ ID NO: 1803 - DNA, 18 bp, Artificial Sequence
  Synthetic Oligonucleotide
cctccccaagtcagttgc

SEQ ID NO: 1804 - DNA, 18 bp, Artificial Sequence
  Synthetic Oligonucleotide
cccgttcggtctgaggaa

SEQ ID NO: 1805 - DNA, 19 bp, Artificial Sequence
  Synthetic Oligonucleotide
tccggttcgccatgtcccg

SEQ ID NO: 1806 - DNA, 22 bp, Artificial Sequence
  Synthetic Oligonucleotide
gagcactcaaggtagccaaagg

SEQ ID NO: 1807 - DNA, 20 bp, Artificial Sequence
  Synthetic Oligonucleotide
ccagacgagcgattagaagc

SEQ ID NO: 1808 - DNA, 23 bp, Artificial Sequence
  Synthetic Oligonucleotide
tgtgaggtgaatgatttggggga

SEQ ID NO: 1809 - DNA, 20 bp, Artificial Sequence
  Synthetic Oligonucleotide
tcctcctcttcctcctcctc

SEQ ID NO: 1810 - DNA, 20 bp, Artificial Sequence
  Synthetic Oligonucleotide
accctggaagagatggatca

SEQ ID NO: 1811 - DNA, 26 bp, Artificial Sequence
  Synthetic Oligonucleotide
ccatcatacagatcacacactcccgg

SEQ ID NO: 1812 - DNA, 20 bp, Artificial Sequence
  Synthetic Oligonucleotide
attgggtccccataaacaaa

SEQ ID NO: 1813 - DNA, 22 bp, Artificial Sequence
  Synthetic Oligonucleotide
tgtgcacataggaatgagcttc

SEQ ID NO: 1814 - DNA, 24 bp, Artificial Sequence
  Synthetic Oligonucleotide
tcactctctttgctggccaactgc

SEQ ID NO: 1815 - DNA, 20 bp, Artificial Sequence
  Synthetic Oligonucleotide
gtttagcacgcaattgctca

SEQ ID NO: 1816 - DNA, 18 bp, Artificial Sequence
  Synthetic Oligonucleotide
gatccgagaccctcgctc

SEQ ID NO: 1817 - DNA, 23 bp, Artificial Sequence
  Synthetic Oligonucleotide
cccatcaacgtggagagcttgct

SEQ ID NO: 1818 - DNA, 21 bp, Artificial Sequence
  Synthetic Oligonucleotide
aggaccaaggaatttaagcca

SEQ ID NO: 1819 - DNA, 24 bp, Artificial Sequence
  Synthetic Oligonucleotide
ccattctatcatcaacgggtacaa

SEQ ID NO: 1820 - DNA, 25 bp, Artificial Sequence
  Synthetic Oligonucleotide
tctccacagacaaggccaggactcg

SEQ ID NO: 1821 - DNA, 23 bp, Artificial Sequence
  Synthetic Oligonucleotide
tcagcaagtgggaaggtgtaatc

SEQ ID NO: 1822 - DNA, 20 bp, Artificial Sequence
  Synthetic Oligonucleotide
cagtcggctttaccctatcg

SEQ ID NO: 1823 - DNA, 24 bp, Artificial Sequence
  Synthetic Oligonucleotide
caacttcaaccaagtggggacgct

SEQ ID NO: 1824 - DNA, 19 bp, Artificial Sequence
  Synthetic Oligonucleotide
tctgctccttcacgtcgtc

SEQ ID NO: 1825 - DNA, 20 bp, Artificial Sequence
  Synthetic Oligonucleotide
gggctactggcagctacatt

SEQ ID NO: 1826 - DNA, 25 bp, Artificial Sequence
  Synthetic Oligonucleotide
cattggaattgccattagtcccagc

SEQ ID NO: 1827 - DNA, 20 bp, Artificial Sequence
  Synthetic Oligonucleotide
ctctcagcatcggtacaagg

SEQ ID NO: 1828 - DNA, 20 bp, Artificial Sequence
  Synthetic Oligonucleotide
cagcgggattaaacagtcct

SEQ ID NO: 1829 - DNA, 25 bp, Artificial Sequence
  Synthetic Oligonucleotide
ccagcacagccagttaaaagatgca

SEQ ID NO: 1830 - DNA, 20 bp, Artificial Sequence
  Synthetic Oligonucleotide
atctgcgttgaagcagtgag

SEQ ID NO: 1831 - DNA, 20 bp, Artificial Sequence
  Synthetic Oligonucleotide
gactggagtggtgtttggtg

SEQ ID NO: 1832 - DNA, 26 bp, Artificial Sequence
  Synthetic Oligonucleotide
ccagcctattcctgctgctttcattg

SEQ ID NO: 1833 - DNA, 20 bp, Artificial Sequence
  Synthetic Oligonucleotide
ctgttacgctcacaatgctg

SEQ ID NO: 1834 - DNA, 20 bp, Artificial Sequence
  Synthetic Oligonucleotide
aacagagacattgccaacca

SEQ ID NO: 1835 - DNA, 24 bp, Artificial Sequence
  Synthetic Oligonucleotide
ttggatctgcttgctgtccaaacc

SEQ ID NO: 1836 - DNA, 20 bp, Artificial Sequence
  Synthetic Oligonucleotide
gtgatttgcccaggaagttt

SEQ ID NO: 1837 - DNA, 20 bp, Artificial Sequence
  Synthetic Oligonucleotide
gctctgttgtgtcctgttgc

SEQ ID NO: 1838 - DNA, 23 bp, Artificial Sequence
  Synthetic Oligonucleotide
tcagtcacaggaaggccagagcc

SEQ ID NO: 1839 - DNA, 21 bp, Artificial Sequence
  Synthetic Oligonucleotide
gtacggagaagccacttcaca

SEQ ID NO: 1840 - DNA, 20 bp, Artificial Sequence
  Synthetic Oligonucleotide
tggacaaggtgatgaaggag

SEQ ID NO: 1841 - DNA, 24 bp, Artificial Sequence
  Synthetic Oligonucleotide
cctccccgtctccattctcgtcta

SEQ ID NO: 1842 - DNA, 20 bp, Artificial Sequence
  Synthetic Oligonucleotide
agcaccacatactcctggaa

SEQ ID NO: 1843 - DNA, 21 bp, Artificial Sequence
  Synthetic Oligonucleotide
tggctgtgctggtcactacct

SEQ ID NO: 1844 - DNA, 27 bp, Artificial Sequence
  Synthetic Oligonucleotide
cacaagtactcctgccaagagggcgac

SEQ ID NO: 1845 - DNA, 22 bp, Artificial Sequence
  Synthetic Oligonucleotide
tcccccttactcagcttgaact

SEQ ID NO: 1846 - DNA, 18 bp, Artificial Sequence
  Synthetic Oligonucleotide
gactgctgtcatggcgtg

SEQ ID NO: 1847 - DNA, 24 bp, Artificial Sequence
  Synthetic Oligonucleotide
atcacatccagggccttctccaga

SEQ ID NO: 1848 - DNA, 22 bp, Artificial Sequence
  Synthetic Oligonucleotide
cgagtacttgtggaaggtggac

SEQ ID NO: 1849 - DNA, 22 bp, Artificial Sequence
  Synthetic Oligonucleotide
actccctgataaaggggaattt

SEQ ID NO: 1850 - DNA, 24 bp, Artificial Sequence
  Synthetic Oligonucleotide
catgccgtctacagggatgacctg

SEQ ID NO: 1851 - DNA, 21 bp, Artificial Sequence
  Synthetic Oligonucleotide
tgaggacactcggtctctagc

SEQ ID NO: 1852 - DNA, 20 bp, Artificial Sequence
  Synthetic Oligonucleotide
ctttgggacagagtgcaaga

SEQ ID NO: 1853 - DNA, 24 bp, Artificial Sequence
  Synthetic Oligonucleotide
cgatgacttgcaaaatgtcgcagc

SEQ ID NO: 1854 - DNA, 20 bp, Artificial Sequence
  Synthetic Oligonucleotide
tggtctctatgttgcgttcc

SEQ ID NO: 1855 - DNA, 21 bp, Artificial Sequence
  Synthetic Oligonucleotide
agacaaggatgccgtggataa

SEQ ID NO: 1856 - DNA, 23 bp, Artificial Sequence
  Synthetic Oligonucleotide
ttgctcaaggacctggacgccaa

SEQ ID NO: 1857 - DNA, 20 bp, Artificial Sequence
  Synthetic Oligonucleotide
gaagtccacctgggcatctc

SEQ ID NO: 1858 - DNA, 20 bp, Artificial Sequence
  Synthetic Oligonucleotide
ccttttaccactgcctggtt

SEQ ID NO: 1859 - DNA, 24 bp, Artificial Sequence
  Synthetic Oligonucleotide
tccagtgctctttcggcacttctg

SEQ ID NO: 1860 - DNA, 19 bp, Artificial Sequence
  Synthetic Oligonucleotide
acaatgctgtgtccttccg

SEQ ID NO: 1861 - DNA, 18 bp, Artificial Sequence
  Synthetic Oligonucleotide
ggactcaacgatgggcag

SEQ ID NO: 1862 - DNA, 24 bp, Artificial Sequence
  Synthetic Oligonucleotide
ccctgtctgcacctcccagatctt

SEQ ID NO: 1863 - DNA, 20 bp, Artificial Sequence
  Synthetic Oligonucleotide
cggaaagattcaaaagcagg

SEQ ID NO: 1864 - DNA, 20 bp, Artificial Sequence
  Synthetic Oligonucleotide
gaaattgacgaggggtgtct

SEQ ID NO: 1865 - DNA, 22 bp, Artificial Sequence
  Synthetic Oligonucleotide
ctctgagcgcctccatccaagg

SEQ ID NO: 1866 - DNA, 20 bp, Artificial Sequence
  Synthetic Oligonucleotide
aggagctaacggagaacctg

SEQ ID NO: 1867 - DNA, 22 bp, Artificial Sequence
  Synthetic Oligonucleotide
gctccaggatgtgtttctgttg

SEQ ID NO: 1868 - DNA, 18 bp, Artificial Sequence
  Synthetic Oligonucleotide
tcgcgggaccaccggacc

SEQ ID NO: 1869 - DNA, 21 bp, Artificial Sequence
  Synthetic Oligonucleotide
acgtggagaagacggcataga

SEQ ID NO: 1870 - DNA, 20 bp, Artificial Sequence
  Synthetic Oligonucleotide
cgcgagcccctcattataca

SEQ ID NO: 1871 - DNA, 22 bp, Artificial Sequence
  Synthetic Oligonucleotide
ctccccacagcgcatcgaggaa

SEQ ID NO: 1872 - DNA, 19 bp, Artificial Sequence
  Synthetic Oligonucleotide
cactcgccgttgacatcct

SEQ ID NO: 1873 - DNA, 20 bp, Artificial Sequence
  Synthetic Oligonucleotide
ttccagcccaacacagtgaa

SEQ ID NO: 1874 - DNA, 22 bp, Artificial Sequence
  Synthetic Oligonucleotide
actttggcctgcccgctcctct

SEQ ID NO: 1875 - DNA, 18 bp, Artificial Sequence
  Synthetic Oligonucleotide
gagtcgggtcgccaggtt

SEQ ID NO: 1876 - DNA, 19 bp, Artificial Sequence
  Synthetic Oligonucleotide
caagctgaacggtgtgtcc

SEQ ID NO: 1877 - DNA, 24 bp, Artificial Sequence
  Synthetic Oligonucleotide
cagcaccgatttcttcaggtccct

SEQ ID NO: 1878 - DNA, 19 bp, Artificial Sequence
  Synthetic Oligonucleotide
tgcaagctgtctttgagcc

SEQ ID NO: 1879 - DNA, 18 bp, Artificial Sequence
  Synthetic Oligonucleotide
tacaggatgaggctgggc

SEQ ID NO: 1880 - DNA, 24 bp, Artificial Sequence
  Synthetic Oligonucleotide
cctgggacagcctatgtaaggcca

SEQ ID NO: 1881 - DNA, 18 bp, Artificial Sequence
  Synthetic Oligonucleotide
gttgttagggcaaggggc

SEQ ID NO: 1882 - DNA, 23 bp, Artificial Sequence
  Synthetic Oligonucleotide
cagtggagaccagttgggtagtg

SEQ ID NO: 1883 - DNA, 28 bp, Artificial Sequence
  Synthetic Oligonucleotide
cacacatgcagagcttgtagcgtaccca

SEQ ID NO: 1884 - DNA, 20 bp, Artificial Sequence
  Synthetic Oligonucleotide
ccttgaagagcgtcccatca

SEQ ID NO: 1885 - DNA, 20 bp, Artificial Sequence
  Synthetic Oligonucleotide
ccaacaccttcttggcttct

SEQ ID NO: 1886 - DNA, 24 bp, Artificial Sequence
  Synthetic Oligonucleotide
cctgtgttcttgctgagcaccctc

SEQ ID NO: 1887 - DNA, 20 bp, Artificial Sequence
  Synthetic Oligonucleotide
ctgttatcccaacccaaacc

SEQ ID NO: 1888 - DNA, 21 bp, Artificial Sequence
  Synthetic Oligonucleotide
gtccaaggcacatatccactg

SEQ ID NO: 1889 - DNA, 24 bp, Artificial Sequence
  Synthetic Oligonucleotide
caccgagttctctgctttcaccga

SEQ ID NO: 1890 - DNA, 18 bp, Artificial Sequence
  Synthetic Oligonucleotide
gaagcagcctcccgattt

SEQ ID NO: 1891 - DNA, 20 bp, Artificial Sequence
  Synthetic Oligonucleotide
aacggactccctcaatttgt

SEQ ID NO: 1892 - DNA, 24 bp, Artificial Sequence
  Synthetic Oligonucleotide
tgtccatggtcatgcaaatcttgc

SEQ ID NO: 1893 - DNA, 20 bp, Artificial Sequence
  Synthetic Oligonucleotide
gaaattgcagggtccaagat

SEQ ID NO: 1894 - DNA, 21 bp, Artificial Sequence
  Synthetic Oligonucleotide
ttggcattggaactacattca

SEQ ID NO: 1895 - DNA, 24 bp, Artificial Sequence
  Synthetic Oligonucleotide
tccgcggtatcctcggattagttc

SEQ ID NO: 1896 - DNA, 19 bp, Artificial Sequence
  Synthetic Oligonucleotide
ggtatggagaagggggtcc

SEQ ID NO: 1897 - DNA, 20 bp, Artificial Sequence
  Synthetic Oligonucleotide
aaccacagttggaggaggac

SEQ ID NO: 1898 - DNA, 23 bp, Artificial Sequence
  Synthetic Oligonucleotide
cagagacagtttccctccccgct

SEQ ID NO: 1899 - DNA, 20 bp, Artificial Sequence
  Synthetic Oligonucleotide
cgaaggaagggtgttggtat

SEQ ID NO: 1900 - DNA, 18 bp, Artificial Sequence
  Synthetic Oligonucleotide
tccagcccaaatcctcct

SEQ ID NO: 1901 - DNA, 24 bp, Artificial Sequence
  Synthetic Oligonucleotide
tggcacatcctaccccagatgcta

SEQ ID NO: 1902 - DNA, 20 bp, Artificial Sequence
  Synthetic Oligonucleotide
ggtgtcctggagtccttgaa

SEQ ID NO: 1903 - DNA, 20 bp, Artificial Sequence
  Synthetic Oligonucleotide
gatggtaggaagggatgtgc

SEQ ID NO: 1904 - DNA, 23 bp, Artificial Sequence
  Synthetic Oligonucleotide
cgcctctccacgcactcagctat

SEQ ID NO: 1905 - DNA, 21 bp, Artificial Sequence
  Synthetic Oligonucleotide
cacaaggagctgtgaatgagg

SEQ ID NO: 1906 - DNA, 20 bp, Artificial Sequence
  Synthetic Oligonucleotide
ccagagtcatgctcatccag

SEQ ID NO: 1907 - DNA, 23 bp, Artificial Sequence
  Synthetic Oligonucleotide
ctgtccctgcactggtgcaactg

SEQ ID NO: 1908 - DNA, 20 bp, Artificial Sequence
  Synthetic Oligonucleotide
ccaccttcagcctctgaaat

SEQ ID NO: 1909 - DNA, 20 bp, Artificial Sequence
  Synthetic Oligonucleotide
agctggggtgtctgtttcat

SEQ ID NO: 1910 - DNA, 23 bp, Artificial Sequence
  Synthetic Oligonucleotide
cctgacttcaggtcaagggatgg

SEQ ID NO: 1911 - DNA, 20 bp, Artificial Sequence
  Synthetic Oligonucleotide
acagcaaggcgagcataaat

SEQ ID NO: 1912 - DNA, 22 bp, Artificial Sequence
  Synthetic Oligonucleotide
ccattgcctttgctttgttcat

SEQ ID NO: 1913 - DNA, 27 bp, Artificial Sequence
  Synthetic Oligonucleotide
tcccatggtttttattctgccctgctg

SEQ ID NO: 1914 - DNA, 21 bp, Artificial Sequence
  Synthetic Oligonucleotide
ttccggatttcctttctttgc

SEQ ID NO: 1915 - DNA, 23 bp, Artificial Sequence
  Synthetic Oligonucleotide
agttgcagaatctaagcctggaa

SEQ ID NO: 1916 - DNA, 20 bp, Artificial Sequence
  Synthetic Oligonucleotide
cctgcggctttcggatccca

SEQ ID NO: 1917 - DNA, 25 bp, Artificial Sequence
  Synthetic Oligonucleotide
tgagttttttgcgagagtattgaca

SEQ ID NO: 1918 - DNA, 20 bp, Artificial Sequence
  Synthetic Oligonucleotide
tctgccagtgctgaattctt

SEQ ID NO: 1919 - DNA, 24 bp, Artificial Sequence
  Synthetic Oligonucleotide
tgctgacattgccctggctcctat

SEQ ID NO: 1920 - DNA, 20 bp, Artificial Sequence
  Synthetic Oligonucleotide
ttcgaaccttagcagcttcc

SEQ ID NO: 1921 - DNA, 18 bp, Artificial Sequence
  Synthetic Oligonucleotide
gcctgagtctcctgtgcc

SEQ ID NO: 1922 - DNA, 24 bp, Artificial Sequence
  Synthetic Oligonucleotide
acatcccaggcttcaccctgaatg

SEQ ID NO: 1923 - DNA, 19 bp, Artificial Sequence
  Synthetic Oligonucleotide
agtctccaccctcaggcat

SEQ ID NO: 1924 - DNA, 19 bp, Artificial Sequence
  Synthetic Oligonucleotide
ccgttcgaagagtcgtgag

SEQ ID NO: 1925 - DNA, 24 bp, Artificial Sequence
  Synthetic Oligonucleotide
tctccgaatcttaacccgtcaccc

SEQ ID NO: 1926 - DNA, 20 bp, Artificial Sequence
  Synthetic Oligonucleotide
agtccagccactagcacctc

SEQ ID NO: 1927 - DNA, 20 bp, Artificial Sequence
  Synthetic Oligonucleotide
cctgctttcaaccacattga

SEQ ID NO: 1928 - DNA, 24 bp, Artificial Sequence
  Synthetic Oligonucleotide
tcccattgctcttgccactctgat

SEQ ID NO: 1929 - DNA, 20 bp, Artificial Sequence
  Synthetic Oligonucleotide
agagcagcttcacaaacgag

SEQ ID NO: 1930 - DNA, 18 bp, Artificial Sequence
  Synthetic Oligonucleotide
gcgcagaggccagttaaa

SEQ ID NO: 1931 - DNA, 24 bp, Artificial Sequence
  Synthetic Oligonucleotide
agatcacctcctcgaacccactcc

SEQ ID NO: 1932 - DNA, 18 bp, Artificial Sequence
  Synthetic Oligonucleotide
agctgagctgtgggttgc

SEQ ID NO: 1933 - DNA, 19 bp, Artificial Sequence
  Synthetic Oligonucleotide
atggccaatgtttgatgct

SEQ ID NO: 1934 - DNA, 25 bp, Artificial Sequence
  Synthetic Oligonucleotide
tggccatccatctcacagaaattgg

SEQ ID NO: 1935 - DNA, 20 bp, Artificial Sequence
  Synthetic Oligonucleotide
acacttcaagtcacgcttgc

SEQ ID NO: 1936 - DNA, 19 bp, Artificial Sequence
  Synthetic Oligonucleotide
agggactgtcctggcacat

SEQ ID NO: 1937 - DNA, 24 bp, Artificial Sequence
  Synthetic Oligonucleotide
agcaaaagacccaggacatctgca

SEQ ID NO: 1938 - DNA, 19 bp, Artificial Sequence
  Synthetic Oligonucleotide
caacaaatttgccgcagtc

SEQ ID NO: 1939 - DNA, 20 bp, Artificial Sequence
  Synthetic Oligonucleotide
cccaatcggaagcctaacta

SEQ ID NO: 1940 - DNA, 25 bp, Artificial Sequence
  Synthetic Oligonucleotide
tctggattagagtcctgcagctcgc

SEQ ID NO: 1941 - DNA, 20 bp, Artificial Sequence
  Synthetic Oligonucleotide
gtagggctgctggaaggtaa

SEQ ID NO: 1942 - DNA, 19 bp, Artificial Sequence
  Synthetic Oligonucleotide
ggctggccaaacataagca

SEQ ID NO: 1943 - DNA, 29 bp, Artificial Sequence
  Synthetic Oligonucleotide
ctgcactgcgatgcccagtctagaaaatc

SEQ ID NO: 1944 - DNA, 26 bp, Artificial Sequence
  Synthetic Oligonucleotide
tccttgtcacagtatttacagctgaa

SEQ ID NO: 1945 - DNA, 20 bp, Artificial Sequence
  Synthetic Oligonucleotide
ggctggtcggcagagagtag

SEQ ID NO: 1946 - DNA, 29 bp, Artificial Sequence
  Synthetic Oligonucleotide
aaactcatgtaaaccacggccgaatgttg

SEQ ID NO: 1947 - DNA, 21 bp, Artificial Sequence
  Synthetic Oligonucleotide
tgaggaaaggtttgggattga

SEQ ID NO: 1948 - DNA, 20 bp, Artificial Sequence
  Synthetic Oligonucleotide
tgaagagaggcatgttggag

SEQ ID NO: 1949 - DNA, 24 bp, Artificial Sequence
  Synthetic Oligonucleotide
tttgtcagcagtcacattgcccaa

SEQ ID NO: 1950 - DNA, 20 bp, Artificial Sequence
  Synthetic Oligonucleotide
aatagacacatcggccacac

SEQ ID NO: 1951 - DNA, 21 bp, Artificial Sequence
  Synthetic Oligonucleotide
gcttgtccaaatcaggatcca

SEQ ID NO: 1952 - DNA, 27 bp, Artificial Sequence
  Synthetic Oligonucleotide
aacaacaggccttattccactgctggg

SEQ ID NO: 1953 - DNA, 19 bp, Artificial Sequence
  Synthetic Oligonucleotide
agcgtgctcccacacatca

SEQ ID NO: 1954 - DNA, 20 bp, Artificial Sequence
  Synthetic Oligonucleotide
tctgcaccaaattctccaag

SEQ ID NO: 1955 - DNA, 23 bp, Artificial Sequence
  Synthetic Oligonucleotide
aacaccgttaacacctccgcctg

SEQ ID NO: 1956 - DNA, 20 bp, Artificial Sequence
  Synthetic Oligonucleotide
gtggtactggaagcaccaga

SEQ ID NO: 1957 - DNA, 18 bp, Artificial Sequence
  Synthetic Oligonucleotide
tcgtgtgcaagcctgaga

SEQ ID NO: 1958 - DNA, 23 bp, Artificial Sequence
  Synthetic Oligonucleotide
ctcccctaccaggggcatgactc

SEQ ID NO: 1959 - DNA, 19 bp, Artificial Sequence
  Synthetic Oligonucleotide
ctgtcggggagattcacac

SEQ ID NO: 1960 - DNA, 23 bp, Artificial Sequence
  Synthetic Oligonucleotide
tcttccctgtacactggcagttc

SEQ ID NO: 1961 - DNA, 22 bp, Artificial Sequence
  Synthetic Oligonucleotide
tggaccagcaccccattgacgg

SEQ ID NO: 1962 - DNA, 20 bp, Artificial Sequence
  Synthetic Oligonucleotide
agctcggtgtgggagaggta

SEQ ID NO: 1963 - DNA, 19 bp, Artificial Sequence
  Synthetic Oligonucleotide
aggaatgcagcggattcct

SEQ ID NO: 1964 - DNA, 23 bp, Artificial Sequence
  Synthetic Oligonucleotide
cccaagtgctcccagaaggcagg

SEQ ID NO: 1965 - DNA, 20 bp, Artificial Sequence
  Synthetic Oligonucleotide
tcgctggagtggtcttcaga

SEQ ID NO: 1966 - DNA, 22 bp, Artificial Sequence
  Synthetic Oligonucleotide
cagaccagtccctggtcatagg

SEQ ID NO: 1967 - DNA, 23 bp, Artificial Sequence
  Synthetic Oligonucleotide
ctgggtccggattgccctttcag

SEQ ID NO: 1968 - DNA, 24 bp, Artificial Sequence
  Synthetic Oligonucleotide
ccttcaagtcatccacaatcagtt

SEQ ID NO: 1969 - DNA, 20 bp, Artificial Sequence
  Synthetic Oligonucleotide
tgtggcaagtgcaaatgtaa

SEQ ID NO: 1970 - DNA, 24 bp, Artificial Sequence
  Synthetic Oligonucleotide
cagaggccttgggtaggtgcactc

SEQ ID NO: 1971 - DNA, 20 bp, Artificial Sequence
  Synthetic Oligonucleotide
gtcgcagatccagtctgatg

SEQ ID NO: 1972 - DNA, 20 bp, Artificial Sequence
  Synthetic Oligonucleotide
agatggaagaagccaacctg

SEQ ID NO: 1973 - DNA, 22 bp, Artificial Sequence
  Synthetic Oligonucleotide
ctggatcagctcctgggccttc

SEQ ID NO: 1974 - DNA, 19 bp, Artificial Sequence
  Synthetic Oligonucleotide
ctgtggctgaggatctggt

SEQ ID NO: 1975 - DNA, 20 bp, Artificial Sequence
  Synthetic Oligonucleotide
tgactgcacatggaacattg

SEQ ID NO: 1976 - DNA, 22 bp, Artificial Sequence
  Synthetic Oligonucleotide
aggtgcccaacaaccagcatgt

SEQ ID NO: 1977 - DNA, 20 bp, Artificial Sequence
  Synthetic Oligonucleotide
aagaatttgaagcgcacctt

SEQ ID NO: 1978 - DNA, 20 bp, Artificial Sequence
  Synthetic Oligonucleotide
gggctcagctttcagaagtg

SEQ ID NO: 1979 - DNA, 25 bp, Artificial Sequence
  Synthetic Oligonucleotide
tggcagttttcttctgtcaccaaaa

SEQ ID NO: 1980 - DNA, 20 bp, Artificial Sequence
  Synthetic Oligonucleotide
acatgttcagctggtccaca

SEQ ID NO: 1981 - DNA, 20 bp, Artificial Sequence
  Synthetic Oligonucleotide
tcacatgccactttggtgtt

SEQ ID NO: 1982 - DNA, 22 bp, Artificial Sequence
  Synthetic Oligonucleotide
tcctgggagagattgaccagca

SEQ ID NO: 1983 - DNA, 20 bp, Artificial Sequence
  Synthetic Oligonucleotide
cttgcaggaagcggctatac

SEQ ID NO: 1984 - DNA, 21 bp, Artificial Sequence
  Synthetic Oligonucleotide
gaggcgctcaacatgaaattc

SEQ ID NO: 1985 - DNA, 22 bp, Artificial Sequence
  Synthetic Oligonucleotide
cggttgctctgcacttcggcct

SEQ ID NO: 1986 - DNA, 20 bp, Artificial Sequence
  Synthetic Oligonucleotide
gccaggaacacgaggttctc

SEQ ID NO: 1987 - DNA, 20 bp, Artificial Sequence
  Synthetic Oligonucleotide
ccagtggtggtgatcgttca

SEQ ID NO: 1988 - DNA, 23 bp, Artificial Sequence
  Synthetic Oligonucleotide
cagccaggacaacaatgcgacgg

SEQ ID NO: 1989 - DNA, 21 bp, Artificial Sequence
  Synthetic Oligonucleotide
gcaaaagcattgtcccagaga

SEQ ID NO: 1990 - DNA, 19 bp, Artificial Sequence
  Synthetic Oligonucleotide
ctccgaggtgaggaggact

SEQ ID NO: 1991 - DNA, 24 bp, Artificial Sequence
  Synthetic Oligonucleotide
cacatcaaacgcacatcccatgag

SEQ ID NO: 1992 - DNA, 20 bp, Artificial Sequence
  Synthetic Oligonucleotide
acctctccctggttatgcac

SEQ ID NO: 1993 - DNA, 18 bp, Artificial Sequence
  Synthetic Oligonucleotide
ggactcggagacgctgtg

SEQ ID NO: 1994 - DNA, 24 bp, Artificial Sequence
  Synthetic Oligonucleotide
ttcttgaggatcttgacggccctc

SEQ ID NO: 1995 - DNA, 20 bp, Artificial Sequence
  Synthetic Oligonucleotide
gggatccttcgcaacttctt

SEQ ID NO: 1996 - DNA, 20 bp, Artificial Sequence
  Synthetic Oligonucleotide
catcttccaggaggaccact

SEQ ID NO: 1997 - DNA, 24 bp, Artificial Sequence
  Synthetic Oligonucleotide
ctctgtggcaccctggactacctg

SEQ ID NO: 1998 - DNA, 20 bp, Artificial Sequence
  Synthetic Oligonucleotide
tccgaccttcaatcatttca

SEQ ID NO: 1999 - DNA, 20 bp, Artificial Sequence
  Synthetic Oligonucleotide
aatacccaacgcacaaatga

SEQ ID NO: 2000 - DNA, 23 bp, Artificial Sequence
  Synthetic Oligonucleotide
cacgttctctgccccgtttcttg

SEQ ID NO: 2001 - DNA, 20 bp, Artificial Sequence
  Synthetic Oligonucleotide
ggagacaatgcaaaccacac

SEQ ID NO: 2002 - DNA, 20 bp, Artificial Sequence
  Synthetic Oligonucleotide
cctggaggctgcaacatacc

SEQ ID NO: 2003 - DNA, 25 bp, Artificial Sequence
  Synthetic Oligonucleotide
atcctcctgaagcccttttcgcagc

SEQ ID NO: 2004 - DNA, 23 bp, Artificial Sequence
  Synthetic Oligonucleotide
tacaatggctttggaggatagca

SEQ ID NO: 2005 - DNA, 25 bp, Artificial Sequence
  Synthetic Oligonucleotide
gaagatccctttcctcctactgttc

SEQ ID NO: 2006 - DNA, 22 bp, Artificial Sequence
  Synthetic Oligonucleotide
cttcgtggctctcggcttccca

SEQ ID NO: 2007 - DNA, 20 bp, Artificial Sequence
  Synthetic Oligonucleotide
ggatgatgttcggccttgat

SEQ ID NO: 2008 - DNA, 20 bp, Artificial Sequence
  Synthetic Oligonucleotide
tgttttgattcccgggctta

SEQ ID NO: 2009 - DNA, 28 bp, Artificial Sequence
  Synthetic Oligonucleotide
tgccttcttcctccctcacttctcacct

SEQ ID NO: 2010 - DNA, 24 bp, Artificial Sequence
  Synthetic Oligonucleotide
caaagctgtcagctctagcaaaag

SEQ ID NO: 2011 - DNA, 20 bp, Artificial Sequence
  Synthetic Oligonucleotide
gatggagcaggtggctcagt

SEQ ID NO: 2012 - DNA, 24 bp, Artificial Sequence
  Synthetic Oligonucleotide
cccagagtcctcagccgccttcag

SEQ ID NO: 2013 - DNA, 25 bp, Artificial Sequence
  Synthetic Oligonucleotide
agtctggaacatgtcagtcttgatg

SEQ ID NO: 2014 - DNA, 19 bp, Artificial Sequence
  Synthetic Oligonucleotide
gcccgaaacgccgaatata

SEQ ID NO: 2015 - DNA, 21 bp, Artificial Sequence
  Synthetic Oligonucleotide
taccgcagcaaaccgcttggg

SEQ ID NO: 2016 - DNA, 23 bp, Artificial Sequence
  Synthetic Oligonucleotide
cgtggctctcttatcctcatgat

SEQ ID NO: 2017 - DNA, 18 bp, Artificial Sequence
  Synthetic Oligonucleotide
gaggtcctgagcactgcc

SEQ ID NO: 2018 - DNA, 24 bp, Artificial Sequence
  Synthetic Oligonucleotide
ctgggttcacaggctcctttgtcc

SEQ ID NO: 2019 - DNA, 19 bp, Artificial Sequence
  Synthetic Oligonucleotide
gatgtgggaccatgcttgt

SEQ ID NO: 2020 - DNA, 20 bp, Artificial Sequence
  Synthetic Oligonucleotide
gcagctgcagtcaacagttc

SEQ ID NO: 2021 - DNA, 24 bp, Artificial Sequence
  Synthetic Oligonucleotide
aagtcatggcccaaatccagtgtg

SEQ ID NO: 2022 - DNA, 18 bp, Artificial Sequence
  Synthetic Oligonucleotide
ctgtgaatggggaggggt

SEQ ID NO: 2023 - DNA, 19 bp, Artificial Sequence
  Synthetic Oligonucleotide
ccgggacactttccagaag

SEQ ID NO: 2024 - DNA, 24 bp, Artificial Sequence
  Synthetic Oligonucleotide
tctcacttcggcgaaatagtcccg

SEQ ID NO: 2025 - DNA, 18 bp, Artificial Sequence
  Synthetic Oligonucleotide
agaacgcgctgtcctgag

SEQ ID NO: 2026 - DNA, 20 bp, Artificial Sequence
  Synthetic Oligonucleotide
ccaatcacgacaggaggatt

SEQ ID NO: 2027 - DNA, 24 bp, Artificial Sequence
  Synthetic Oligonucleotide
agacacccctaccccacagctctg

SEQ ID NO: 2028 - DNA, 19 bp, Artificial Sequence
  Synthetic Oligonucleotide
tggacacggaagcattgac

SEQ ID NO: 2029 - DNA, 24 bp, Artificial Sequence
  Synthetic Oligonucleotide
ctgactgctctgcttaaaggtgaa

SEQ ID NO: 2030 - DNA, 29 bp, Artificial Sequence
  Synthetic Oligonucleotide
tagcaggaacaacaacaaaagccaaccaa

SEQ ID NO: 2031 - DNA, 23 bp, Artificial Sequence
  Synthetic Oligonucleotide
atgtcttgcactggctaccttgt

SEQ ID NO: 2032 - DNA, 28 bp, Artificial Sequence
  Synthetic Oligonucleotide
acttcggtgctacttaacaacttacatc

SEQ ID NO: 2033 - DNA, 25 bp, Artificial Sequence
  Synthetic Oligonucleotide
agctcggaccacgtactgctccctg

SEQ ID NO: 2034 - DNA, 19 bp, Artificial Sequence
  Synthetic Oligonucleotide
cctgggccttggtgttgac

SEQ ID NO: 2035 - DNA, 19 bp, Artificial Sequence
  Synthetic Oligonucleotide
aagaggaacggagcgagtc

SEQ ID NO: 2036 - DNA, 23 bp, Artificial Sequence
  Synthetic Oligonucleotide
cacgtcccacagctcagggaatc

SEQ ID NO: 2037 - DNA, 19 bp, Artificial Sequence
  Synthetic Oligonucleotide
atgtgtgagccgagtcctg

SEQ ID NO: 2038 - DNA, 23 bp, Artificial Sequence
  Synthetic Oligonucleotide
gacatggagaacaagctgtttgc

SEQ ID NO: 2039 - DNA, 21 bp, Artificial Sequence
  Synthetic Oligonucleotide
accaaacgcaggagcagcccg

SEQ ID NO: 2040 - DNA, 24 bp, Artificial Sequence
  Synthetic Oligonucleotide
gaggtgtcaccaacaagaaatcat

SEQ ID NO: 2041 - DNA, 25 bp, Artificial Sequence
  Synthetic Oligonucleotide
aggcactgttcatctcagtttttct

SEQ ID NO: 2042 - DNA, 24 bp, Artificial Sequence
  Synthetic Oligonucleotide
cagaaagcttgccgggagcaaagg

SEQ ID NO: 2043 - DNA, 25 bp, Artificial Sequence
  Synthetic Oligonucleotide
catcaggctccagatatgaactttc

SEQ ID NO: 2044 - DNA, 20 bp, Artificial Sequence
  Synthetic Oligonucleotide
ggtgtgccacagaccttcct

SEQ ID NO: 2045 - DNA, 27 bp, Artificial Sequence
  Synthetic Oligonucleotide
ttggcctgtaatcacctgtgcagcctt

SEQ ID NO: 2046 - DNA, 24 bp, Artificial Sequence
  Synthetic Oligonucleotide
acggagttcttgacagagttttga

SEQ ID NO: 2047 - DNA, 20 bp, Artificial Sequence
  Synthetic Oligonucleotide
accagtcccccagaagacta

SEQ ID NO: 2048 - DNA, 21 bp, Artificial Sequence
  Synthetic Oligonucleotide
tcctgagcccgaggaagtccc

SEQ ID NO: 2049 - DNA, 20 bp, Artificial Sequence
  Synthetic Oligonucleotide
cctggtgctgttgtagatgg

SEQ ID NO: 2050 - DNA, 22 bp, Artificial Sequence
  Synthetic Oligonucleotide
ggatcgagctcttccagatcct

SEQ ID NO: 2051 - DNA, 21 bp, Artificial Sequence
  Synthetic Oligonucleotide
cggccagatgagcacattgcc

SEQ ID NO: 2052 - DNA, 20 bp, Artificial Sequence
  Synthetic Oligonucleotide
gccaccgatatagcgctgtt

SEQ ID NO: 2053 - DNA, 19 bp, Artificial Sequence
  Synthetic Oligonucleotide
gctacgagtgctgtcctgg

SEQ ID NO: 2054 - DNA, 24 bp, Artificial Sequence
  Synthetic Oligonucleotide
ccttctccccagggaccttttcat

SEQ ID NO: 2055 - DNA, 19 bp, Artificial Sequence
  Synthetic Oligonucleotide
agtggtagggctgctggac

SEQ ID NO: 2056 - DNA, 18 bp, Artificial Sequence
  Synthetic Oligonucleotide
gtcatcacctggccttgg

SEQ ID NO: 2057 - DNA, 24 bp, Artificial Sequence
  Synthetic Oligonucleotide
agcaatgacagctgccagttccac

SEQ ID NO: 2058 - DNA, 19 bp, Artificial Sequence
  Synthetic Oligonucleotide
gcagacgaagcacactggt

SEQ ID NO: 2059 - DNA, 20 bp, Artificial Sequence
  Synthetic Oligonucleotide
aacaccaatgggttccatct

SEQ ID NO: 2060 - DNA, 24 bp, Artificial Sequence
  Synthetic Oligonucleotide
ttctgggctcctgattgctcaagc

SEQ ID NO: 2061 - DNA, 20 bp, Artificial Sequence
  Synthetic Oligonucleotide
cctcttcatcaggccaaact

SEQ ID NO: 2062 - DNA, 22 bp, Artificial Sequence
  Synthetic Oligonucleotide
catccgcaaagtgactgaagag

SEQ ID NO: 2063 - DNA, 22 bp, Artificial Sequence
  Synthetic Oligonucleotide
ccaatgagctgaggcggcctcc

SEQ ID NO: 2064 - DNA, 27 bp, Artificial Sequence
  Synthetic Oligonucleotide
gtactgaactccgttgtgatagcatag

SEQ ID NO: 2065 - DNA, 20 bp, Artificial Sequence
  Synthetic Oligonucleotide
ggacaagaccctctcaggct

SEQ ID NO: 2066 - DNA, 24 bp, Artificial Sequence
  Synthetic Oligonucleotide
caagctcccaagagcttccagagc

SEQ ID NO: 2067 - DNA, 18 bp, Artificial Sequence
  Synthetic Oligonucleotide
ttggaggctgtgggtcag

SEQ ID NO: 2068 - DNA, 19 bp, Artificial Sequence
  Synthetic Oligonucleotide
tccctgcggtcccagatag

SEQ ID NO: 2069 - DNA, 25 bp, Artificial Sequence
  Synthetic Oligonucleotide
atcctgcccggagtggaactgaagc

SEQ ID NO: 2070 - DNA, 20 bp, Artificial Sequence
  Synthetic Oligonucleotide
gtgggaacagggtggacact

SEQ ID NO: 2071 - DNA, 22 bp, Artificial Sequence
  Synthetic Oligonucleotide
tcaccctctgtgacttcatcgt

SEQ ID NO: 2072 - DNA, 22 bp, Artificial Sequence
  Synthetic Oligonucleotide
ccctgggacaccctgagcacca

SEQ ID NO: 2073 - DNA, 22 bp, Artificial Sequence
  Synthetic Oligonucleotide
tgtggttcaggctcttcttctg

SEQ ID NO: 2074 - DNA, 20 bp, Artificial Sequence
  Synthetic Oligonucleotide
ctacctgccttgctttgtga

SEQ ID NO: 2075 - DNA, 24 bp, Artificial Sequence
  Synthetic Oligonucleotide
ccaagaacgagtgtctctggaccg

SEQ ID NO: 2076 - DNA, 20 bp, Artificial Sequence
  Synthetic Oligonucleotide
accgaaattggagagcatgt

SEQ ID NO: 2077 - DNA, 20 bp, Artificial Sequence
  Synthetic Oligonucleotide
actttgctgggacaaaggtc

SEQ ID NO: 2078 - DNA, 21 bp, Artificial Sequence
  Synthetic Oligonucleotide
ctcgggcctgcccacttcttc

SEQ ID NO: 2079 - DNA, 20 bp, Artificial Sequence
  Synthetic Oligonucleotide
cacatggactcctcagcatc

SEQ ID NO: 2080 - DNA, 20 bp, Artificial Sequence
  Synthetic Oligonucleotide
gccgggaagaccgtaattgt

SEQ ID NO: 2081 - DNA, 26 bp, Artificial Sequence
  Synthetic Oligonucleotide
caaatggcttcctctggaaggtccca

SEQ ID NO: 2082 - DNA, 18 bp, Artificial Sequence
  Synthetic Oligonucleotide
cagcggcaccaggttcag

SEQ ID NO: 2083 - DNA, 22 bp, Artificial Sequence
  Synthetic Oligonucleotide
aagcagaagggagagcgtaaga

SEQ ID NO: 2084 - DNA, 26 bp, Artificial Sequence
  Synthetic Oligonucleotide
cttccaggcacacaagaattgtgggc

SEQ ID NO: 2085 - DNA, 21 bp, Artificial Sequence
  Synthetic Oligonucleotide
ccttggcctcaatctcactca

SEQ ID NO: 2086 - DNA, 18 bp, Artificial Sequence
  Synthetic Oligonucleotide
cagaaggatgcctgtggc

SEQ ID NO: 2087 - DNA, 24 bp, Artificial Sequence
  Synthetic Oligonucleotide
attccgttgcctgacactgtgctc

SEQ ID NO: 2088 - DNA, 18 bp, Artificial Sequence
  Synthetic Oligonucleotide
gtagacctgcggctctgg

SEQ ID NO: 2089 - DNA, 20 bp, Artificial Sequence
  Synthetic Oligonucleotide
gaaatcgccagcttcgataa

SEQ ID NO: 2090 - DNA, 24 bp, Artificial Sequence
  Synthetic Oligonucleotide
cgtctccgttttcttcagcttggc

SEQ ID NO: 2091 - DNA, 19 bp, Artificial Sequence
  Synthetic Oligonucleotide
gtcggcagggtgttctttt

SEQ ID NO: 2092 - DNA, 26 bp, Artificial Sequence
  Synthetic Oligonucleotide
cacatcaaagaactactgacaacgaa

SEQ ID NO: 2093 - DNA, 18 bp, Artificial Sequence
  Synthetic Oligonucleotide
ccgcgcctgcctttccca

SEQ ID NO: 2094 - DNA, 23 bp, Artificial Sequence
  Synthetic Oligonucleotide
cctgccagccagatagatagaca

SEQ ID NO: 2095 - DNA, 18 bp, Artificial Sequence
  Synthetic Oligonucleotide
agctcggaacctcaccgt

SEQ ID NO: 2096 - DNA, 23 bp, Artificial Sequence
  Synthetic Oligonucleotide
cagccttcgggctgtggacatac

SEQ ID NO: 2097 - DNA, 18 bp, Artificial Sequence
  Synthetic Oligonucleotide
gtagcagccttgaggccc

SEQ ID NO: 2098 - DNA, 20 bp, Artificial Sequence
  Synthetic Oligonucleotide
ggagaagggtgaccgactca

SEQ ID NO: 2099 - DNA, 24 bp, Artificial Sequence
  Synthetic Oligonucleotide
cgctgagatcaatcggcccgacta

SEQ ID NO: 2100 - DNA, 18 bp, Artificial Sequence
  Synthetic Oligonucleotide
tgcccagactcggcaaag

SEQ ID NO: 2101 - DNA, 21 bp, Artificial Sequence
  Synthetic Oligonucleotide
tctcacctcgctatggttcgt

SEQ ID NO: 2102 - DNA, 23 bp, Artificial Sequence
  Synthetic Oligonucleotide
tgcctctgcagtgcgtcctctgg

SEQ ID NO: 2103 - DNA, 19 bp, Artificial Sequence
  Synthetic Oligonucleotide
gatggacagcggtcagcaa

SEQ ID NO: 2104 - DNA, 19 bp, Artificial Sequence
  Synthetic Oligonucleotide
cctcagcaccagggtacca

SEQ ID NO: 2105 - DNA, 24 bp, Artificial Sequence
  Synthetic Oligonucleotide
tgacggcacgctcacactcctcag

SEQ ID NO: 2106 - DNA, 21 bp, Artificial Sequence
  Synthetic Oligonucleotide
tgtcctggaaagccacaaagt

SEQ ID NO: 2107 - DNA, 22 bp, Artificial Sequence
  Synthetic Oligonucleotide
cttcatcttccctctacccaga

SEQ ID NO: 2108 - DNA, 24 bp, Artificial Sequence
  Synthetic Oligonucleotide
caggggttggaccctttccatctt

SEQ ID NO: 2109 - DNA, 20 bp, Artificial Sequence
  Synthetic Oligonucleotide
gctgcatttcccacattctc

SEQ ID NO: 2110 - DNA, 20 bp, Artificial Sequence
  Synthetic Oligonucleotide
aatccaagggggagagtgat

SEQ ID NO: 2111 - DNA, 26 bp, Artificial Sequence
  Synthetic Oligonucleotide
catatggactttgactcagctgtggc

SEQ ID NO: 2112 - DNA, 20 bp, Artificial Sequence
  Synthetic Oligonucleotide
gtacagattttgcccgagga

SEQ ID NO: 2113 - DNA, 21 bp, Artificial Sequence
  Synthetic Oligonucleotide
tgtggacatcttcccctcaga

SEQ ID NO: 2114 - DNA, 24 bp, Artificial Sequence
  Synthetic Oligonucleotide
ttccctactgagccaccttctctg

SEQ ID NO: 2115 - DNA, 18 bp, Artificial Sequence
  Synthetic Oligonucleotide
ctagcccgaccggttcgt

SEQ ID NO: 2116 - DNA, 24 bp, Artificial Sequence
  Synthetic Oligonucleotide
ctatatgcagccagagatgtgaca

SEQ ID NO: 2117 - DNA, 23 bp, Artificial Sequence
  Synthetic Oligonucleotide
acagcctgccactcatcacagcc

SEQ ID NO: 2118 - DNA, 24 bp, Artificial Sequence
  Synthetic Oligonucleotide
ccacgagtttcttactgagaatgg

SEQ ID NO: 2119 - DNA, 20 bp, Artificial Sequence
  Synthetic Oligonucleotide
tgctgttgctgagtctgttg

SEQ ID NO: 2120 - DNA, 24 bp, Artificial Sequence
  Synthetic Oligonucleotide
ccagtccccagaagaccatgtctg

SEQ ID NO: 2121 - DNA, 20 bp, Artificial Sequence
  Synthetic Oligonucleotide
cttgcctggcttcacagata

SEQ ID NO: 2122 - DNA, 19 bp, Artificial Sequence
  Synthetic Oligonucleotide
gggccaaatattcagaagc

SEQ ID NO: 2123 - DNA, 20 bp, Artificial Sequence
  Synthetic Oligonucleotide
ccaccatagcggccatggag

SEQ ID NO: 2124 - DNA, 20 bp, Artificial Sequence
  Synthetic Oligonucleotide
ggatgggtatgatgggacag

SEQ ID NO: 2125 - DNA, 20 bp, Artificial Sequence
  Synthetic Oligonucleotide
gcggacttaatgcagagaca

SEQ ID NO: 2126 - DNA, 24 bp, Artificial Sequence
  Synthetic Oligonucleotide
cagtatgacccacctccaggagcc

SEQ ID NO: 2127 - DNA, 20 bp, Artificial Sequence
  Synthetic Oligonucleotide
tcaagtcccaaaatgttgct

SEQ ID NO: 2128 - DNA, 21 bp, Artificial Sequence
  Synthetic Oligonucleotide
gacgctggtctggtgaagatg

SEQ ID NO: 2129 - DNA, 23 bp, Artificial Sequence
  Synthetic Oligonucleotide
ccaggaaaccacgagcctccagc

SEQ ID NO: 2130 - DNA, 20 bp, Artificial Sequence
  Synthetic Oligonucleotide
tgggtggttgttggacaatg

SEQ ID NO: 2131 - DNA, 22 bp, Artificial Sequence
  Synthetic Oligonucleotide
cttcacagtgctcctgcagtct

SEQ ID NO: 2132 - DNA, 26 bp, Artificial Sequence
  Synthetic Oligonucleotide
aagtacacgtaagttacagccacaca

SEQ ID NO: 2133 - DNA, 21 bp, Artificial Sequence
  Synthetic Oligonucleotide
catctgcttcagctcgttggt

SEQ ID NO: 2134 - DNA, 18 bp, Artificial Sequence
  Synthetic Oligonucleotide
gcctcggtgtgcctttca

SEQ ID NO: 2135 - DNA, 22 bp, Artificial Sequence
  Synthetic Oligonucleotide
catcgccagctacgccctgctc

SEQ ID NO: 2136 - DNA, 19 bp, Artificial Sequence
  Synthetic Oligonucleotide
cgtgatgtgcgcaatcatg

SEQ ID NO: 2137 - DNA, 19 bp, Artificial Sequence
  Synthetic Oligonucleotide
ggagccggatgcagtagga

SEQ ID NO: 2138 - DNA, 23 bp, Artificial Sequence
  Synthetic Oligonucleotide
accacggatatggcccgagtcca

SEQ ID NO: 2139 - DNA, 22 bp, Artificial Sequence
  Synthetic Oligonucleotide
aagtccatgaaaggcatgttga

SEQ ID NO: 2140 - DNA, 19 bp, Artificial Sequence
  Synthetic Oligonucleotide
tgtcaccccgactcaacgt

SEQ ID NO: 2141 - DNA, 21 bp, Artificial Sequence
  Synthetic Oligonucleotide
agacgcaccgcccggactcac

SEQ ID NO: 2142 - DNA, 22 bp, Artificial Sequence
  Synthetic Oligonucleotide
acgtggactgagatgcattcac

SEQ ID NO: 2143 - DNA, 20 bp, Artificial Sequence
  Synthetic Oligonucleotide
cgaggacgaggcttaaaaac

SEQ ID NO: 2144 - DNA, 29 bp, Artificial Sequence
  Synthetic Oligonucleotide
tctcagatcaatcgtgcatccttagtgaa

SEQ ID NO: 2145 - DNA, 20 bp, Artificial Sequence
  Synthetic Oligonucleotide
accatgcttgaggacaacag

SEQ ID NO: 2146 - DNA, 19 bp, Artificial Sequence
  Synthetic Oligonucleotide
gtatcaccatcaatgcggc

SEQ ID NO: 2147 - DNA, 24 bp, Artificial Sequence
  Synthetic Oligonucleotide
catgtggagtatagcactgccgcc

SEQ ID NO: 2148 - DNA, 20 bp, Artificial Sequence
  Synthetic Oligonucleotide
cagtctgtgtgggcgtagtg

SEQ ID NO: 2149 - DNA, 22 bp, Artificial Sequence
  Synthetic Oligonucleotide
tgtgtatagtcctgcccctcaa

SEQ ID NO: 2150 - DNA, 26 bp, Artificial Sequence
  Synthetic Oligonucleotide
ccggattatccgacatcttactgtga

SEQ ID NO: 2151 - DNA, 20 bp, Artificial Sequence
  Synthetic Oligonucleotide
cccgatccattcccctttta

SEQ ID NO: 2152 - DNA, 20 bp, Artificial Sequence
  Synthetic Oligonucleotide
ggaggagctaaatgcctcag

SEQ ID NO: 2153 - DNA, 24 bp, Artificial Sequence
  Synthetic Oligonucleotide
actcatcaatgggcagagtgcacc

SEQ ID NO: 2154 - DNA, 20 bp, Artificial Sequence
  Synthetic Oligonucleotide
ccttcaagtggatggtgttg

SEQ ID NO: 2155 - DNA, 18 bp, Artificial Sequence
  Synthetic Oligonucleotide
gagtcgaccctgcacctg

SEQ ID NO: 2156 - DNA, 23 bp, Artificial Sequence
  Synthetic Oligonucleotide
aattaacagccacccctcaggcg

SEQ ID NO: 2157 - DNA, 18 bp, Artificial Sequence
  Synthetic Oligonucleotide
gcgaatgccatgactgaa

SEQ ID NO: 2158 - DNA, 20 bp, Artificial Sequence
  Synthetic Oligonucleotide
acgcaccctgtctgactaca

SEQ ID NO: 2159 - DNA, 24 bp, Artificial Sequence
  Synthetic Oligonucleotide
catccagaaagagtccaccctgca

SEQ ID NO: 2160 - DNA, 20 bp, Artificial Sequence
  Synthetic Oligonucleotide
acctctaagacggagcacca

SEQ ID NO: 2161 - DNA, 20 bp, Artificial Sequence
  Synthetic Oligonucleotide
tgtctggcgataaagggatt

SEQ ID NO: 2162 - DNA, 25 bp, Artificial Sequence
  Synthetic Oligonucleotide
tctgccttccctgaatcagacaacc

SEQ ID NO: 2163 - DNA, 20 bp, Artificial Sequence
  Synthetic Oligonucleotide
atggtccctacccatttgaa

SEQ ID NO: 2164 - DNA, 24 bp, Artificial Sequence
  Synthetic Oligonucleotide
ctccataatttatggcctgcagta

SEQ ID NO: 2165 - DNA, 23 bp, Artificial Sequence
  Synthetic Oligonucleotide
tcttcttggagcccaaccccgag

SEQ ID NO: 2166 - DNA, 18 bp, Artificial Sequence
  Synthetic Oligonucleotide
tgcggcctccttgttcag

SEQ ID NO: 2167 - DNA, 20 bp, Artificial Sequence
  Synthetic Oligonucleotide
gtgaagccaccgtcatcatg

SEQ ID NO: 2168 - DNA, 28 bp, Artificial Sequence
  Synthetic Oligonucleotide
ctgaccaggaggcaaaaccttcaactga

SEQ ID NO: 2169 - DNA, 22 bp, Artificial Sequence
  Synthetic Oligonucleotide
ccttccttcttatcccccaagt

SEQ ID NO: 2170 - DNA, 19 bp, Artificial Sequence
  Synthetic Oligonucleotide
accatgctccagaaggagg

SEQ ID NO: 2171 - DNA, 24 bp, Artificial Sequence
  Synthetic Oligonucleotide
ccccgagccttctacaaagggttc

SEQ ID NO: 2172 - DNA, 18 bp, Artificial Sequence
  Synthetic Oligonucleotide
aacccaagcggagaaagg

SEQ ID NO: 2173 - DNA, 19 bp, Artificial Sequence
  Synthetic Oligonucleotide
ccatgcagcctggaatttg

SEQ ID NO: 2174 - DNA, 25 bp, Artificial Sequence
  Synthetic Oligonucleotide
ctacccagtgccccaacccattctc

SEQ ID NO: 2175 - DNA, 18 bp, Artificial Sequence
  Synthetic Oligonucleotide
gagaggcctgggcacgta

SEQ ID NO: 2176 - DNA, 18 bp, Artificial Sequence
  Synthetic Oligonucleotide
tgcggaaatgagctccac

SEQ ID NO: 2177 - DNA, 24 bp, Artificial Sequence
  Synthetic Oligonucleotide
ccctggccactggggactacacta

SEQ ID NO: 2178 - DNA, 19 bp, Artificial Sequence
  Synthetic Oligonucleotide
cctcagccattctaaccgc

SEQ ID NO: 2179 - DNA, 19 bp, Artificial Sequence
  Synthetic Oligonucleotide
gacagctgatccaggagcc

SEQ ID NO: 2180 - DNA, 24 bp, Artificial Sequence
  Synthetic Oligonucleotide
cgggtcctgcacttcaaggacagt

SEQ ID NO: 2181 - DNA, 18 bp, Artificial Sequence
  Synthetic Oligonucleotide
atggataggcgcaggttg

SEQ ID NO: 2182 - DNA, 18 bp, Artificial Sequence
  Synthetic Oligonucleotide
agaacggaggccgtgact

SEQ ID NO: 2183 - DNA, 24 bp, Artificial Sequence
  Synthetic Oligonucleotide
cgggacgctgctcgactctaagaa

SEQ ID NO: 2184 - DNA, 18 bp, Artificial Sequence
  Synthetic Oligonucleotide
catgcacagcccatctgt

SEQ ID NO: 2185 - DNA, 20 bp, Artificial Sequence
  Synthetic Oligonucleotide
ctgaacacagtggagctggt

SEQ ID NO: 2186 - DNA, 22 bp, Artificial Sequence
  Synthetic Oligonucleotide
acctgccgcacacagagtttgc

SEQ ID NO: 2187 - DNA, 20 bp, Artificial Sequence
  Synthetic Oligonucleotide
ctggaagatctgcccttctc

SEQ ID NO: 2188 - DNA, 19 bp, Artificial Sequence
  Synthetic Oligonucleotide
gtggatgtgccctgaagga

SEQ ID NO: 2189 - DNA, 28 bp, Artificial Sequence
  Synthetic Oligonucleotide
aagccaggcgtctacacgagagtctcac

SEQ ID NO: 2190 - DNA, 20 bp, Artificial Sequence
  Synthetic Oligonucleotide
ctgcggatccagggtaagaa

SEQ ID NO: 2191 - DNA, 18 bp, Artificial Sequence
  Synthetic Oligonucleotide
acgggtcctgcctcagtt

SEQ ID NO: 2192 - DNA, 24 bp, Artificial Sequence
  Synthetic Oligonucleotide
tcagctttctctgcattggctccc

SEQ ID NO: 2193 - DNA, 18 bp, Artificial Sequence
  Synthetic Oligonucleotide
cggggcaatcattgtgac

SEQ ID NO: 2194 - DNA, 21 bp, Artificial Sequence
  Synthetic Oligonucleotide
tggcttcaggagctgaatacc

SEQ ID NO: 2195 - DNA, 26 bp, Artificial Sequence
  Synthetic Oligonucleotide
caggcacacacaggtgggacacaaat

SEQ ID NO: 2196 - DNA, 24 bp, Artificial Sequence
  Synthetic Oligonucleotide
tgctgtcgtgatgagaaaatagtg

SEQ ID NO: 2197 - DNA, 23 bp, Artificial Sequence
  Synthetic Oligonucleotide
gataccacaactcccatcaagct

SEQ ID NO: 2198 - DNA, 18 bp, Artificial Sequence
  Synthetic Oligonucleotide
agtggcagccacggcgcc

SEQ ID NO: 2199 - DNA, 19 bp, Artificial Sequence
  Synthetic Oligonucleotide
tccctgttaggcgcatcag

SEQ ID NO: 2200 - DNA, 19 bp, Artificial Sequence
  Synthetic Oligonucleotide
ggctttggcagcttcagat

SEQ ID NO: 2201 - DNA, 23 bp, Artificial Sequence
  Synthetic Oligonucleotide
agctccaccctggttccctgaag

SEQ ID NO: 2202 - DNA, 18 bp, Artificial Sequence
  Synthetic Oligonucleotide
ctccactgccctgactgg

SEQ ID NO: 2203 - DNA, 19 bp, Artificial Sequence
  Synthetic Oligonucleotide
gctgcgacatggatttcga

SEQ ID NO: 2204 - DNA, 20 bp, Artificial Sequence
  Synthetic Oligonucleotide
ttgctgggccttccatccgg

SEQ ID NO: 2205 - DNA, 20 bp, Artificial Sequence
  Synthetic Oligonucleotide
ccagccctcgtaacctagca

SEQ ID NO: 2206 - DNA, 18 bp, Artificial Sequence
  Synthetic Oligonucleotide
acccacggacagacttgc

SEQ ID NO: 2207 - DNA, 24 bp, Artificial Sequence
  Synthetic Oligonucleotide
cgcgtccaatgtgtattcctccat

SEQ ID NO: 2208 - DNA, 18 bp, Artificial Sequence
  Synthetic Oligonucleotide
agctttgccaaggtcagc

SEQ ID NO: 2209 - DNA, 20 bp, Artificial Sequence
  Synthetic Oligonucleotide
gccctggatttcagaaagag

SEQ ID NO: 2210 - DNA, 25 bp, Artificial Sequence
  Synthetic Oligonucleotide
caagtctggatctgggaccctttcc

SEQ ID NO: 2211 - DNA, 20 bp, Artificial Sequence
  Synthetic Oligonucleotide
agttacaagccagggaagga

SEQ ID NO: 2212 - DNA, 20 bp, Artificial Sequence
  Synthetic Oligonucleotide
ctgctgtcttgggtgcattg

SEQ ID NO: 2213 - DNA, 25 bp, Artificial Sequence
  Synthetic Oligonucleotide
ttgccttgctgctctacctccacca

SEQ ID NO: 2214 - DNA, 18 bp, Artificial Sequence
  Synthetic Oligonucleotide
gcagcctgggaccacttg

SEQ ID NO: 2215 - DNA, 23 bp, Artificial Sequence
  Synthetic Oligonucleotide
tgtgaatgcagaccaaagaaaga

SEQ ID NO: 2216 - DNA, 28 bp, Artificial Sequence
  Synthetic Oligonucleotide
agagcaagacaagaaaatccctgtgggc

SEQ ID NO: 2217 - DNA, 20 bp, Artificial Sequence
  Synthetic Oligonucleotide
gctttctccgctctgagcaa

SEQ ID NO: 2218 - DNA, 22 bp, Artificial Sequence
  Synthetic Oligonucleotide
agcttcctacagcacaacaaat

SEQ ID NO: 2219 - DNA, 29 bp, Artificial Sequence
  Synthetic Oligonucleotide
tgtcttgctctatctttctttggtctgca

SEQ ID NO: 2220 - DNA, 20 bp, Artificial Sequence
  Synthetic Oligonucleotide
ctcggcttgtcacatttttc

SEQ ID NO: 2221 - DNA, 19 bp, Artificial Sequence
  Synthetic Oligonucleotide
tgacgatggcctggagtgt

SEQ ID NO: 2222 - DNA, 21 bp, Artificial Sequence
  Synthetic Oligonucleotide
ctgggcagcaccaagtccgga

SEQ ID NO: 2223 - DNA, 22 bp, Artificial Sequence
  Synthetic Oligonucleotide
ggtaccggatcatgaggatctg

SEQ ID NO: 2224 - DNA, 25 bp, Artificial Sequence
  Synthetic Oligonucleotide
cctcagcaagacgttatttgaaatt

SEQ ID NO: 2225 - DNA, 26 bp, Artificial Sequence
  Synthetic Oligonucleotide
cctctctctcaaggccccaaaccagt

SEQ ID NO: 2226 - DNA, 24 bp, Artificial Sequence
  Synthetic Oligonucleotide
aagtgtgattggcaaaactgattg

SEQ ID NO: 2227 - DNA, 21 bp, Artificial Sequence
  Synthetic Oligonucleotide
tgcccttaaaggaaccaatga

SEQ ID NO: 2228 - DNA, 22 bp, Artificial Sequence
  Synthetic Oligonucleotide
atttcacgcatctggcgttcca

SEQ ID NO: 2229 - DNA, 22 bp, Artificial Sequence
  Synthetic Oligonucleotide
gcttcaacggcaaagttctctt

SEQ ID NO: 2230 - DNA, 19 bp, Artificial Sequence
  Synthetic Oligonucleotide
tacaagctgagtgcccagg

SEQ ID NO: 2231 - DNA, 24 bp, Artificial Sequence
  Synthetic Oligonucleotide
tacaaaagcctccatttcggcacc

SEQ ID NO: 2232 - DNA, 19 bp, Artificial Sequence
  Synthetic Oligonucleotide
cactcgcagatgcgtcttt

SEQ ID NO: 2233 - DNA, 22 bp, Artificial Sequence
  Synthetic Oligonucleotide
agaggcatccatgaacttcaca

SEQ ID NO: 2234 - DNA, 20 bp, Artificial Sequence
  Synthetic Oligonucleotide
cgggctgcatcagcacacgc

SEQ ID NO: 2235 - DNA, 24 bp, Artificial Sequence
  Synthetic Oligonucleotide
caaactccacagtacttgggttga

SEQ ID NO: 2236 - DNA, 20 bp, Artificial Sequence
  Synthetic Oligonucleotide
acaaagctaccagggagtcg

SEQ ID NO: 2237 - DNA, 22 bp, Artificial Sequence
  Synthetic Oligonucleotide
tttgtccacgccattgcctcag

SEQ ID NO: 2238 - DNA, 19 bp, Artificial Sequence
  Synthetic Oligonucleotide
tgagcgtgtcactgcaaag

SEQ ID NO: 2239 - DNA, 25 bp, Artificial Sequence
  Synthetic Oligonucleotide
gtatcaggaccacatgcagtacatc

SEQ ID NO: 2240 - DNA, 24 bp, Artificial Sequence
  Synthetic Oligonucleotide
ttgatgcctgtcttcgcgccttct

SEQ ID NO: 2241 - DNA, 22 bp, Artificial Sequence
  Synthetic Oligonucleotide
tgtcggaattgatactggcatt

SEQ ID NO: 2242 - DNA, 20 bp, Artificial Sequence
  Synthetic Oligonucleotide
tgtcttcagggtcttgtcca

SEQ ID NO: 2243 - DNA, 24 bp, Artificial Sequence
  Synthetic Oligonucleotide
ttccgtaagaggcctggtgctctc

SEQ ID NO: 2244 - DNA, 20 bp, Artificial Sequence
  Synthetic Oligonucleotide
gtgcacgtggatgaaagagt

SEQ ID NO: 2245 - DNA, 18 bp, Artificial Sequence
  Synthetic Oligonucleotide
cggtggaatctggctctg

SEQ ID NO: 2246 - DNA, 24 bp, Artificial Sequence
  Synthetic Oligonucleotide
ctccctctgctcttgacctggctc

SEQ ID NO: 2247 - DNA, 20 bp, Artificial Sequence
  Synthetic Oligonucleotide
ccatgaagagttgacctcgg

SEQ ID NO: 2248 - DNA, 19 bp, Artificial Sequence
  Synthetic Oligonucleotide
atcgcagctggtgggtgta

SEQ ID NO: 2249 - DNA, 26 bp, Artificial Sequence
  Synthetic Oligonucleotide
ctgctgtttaccttggcgaggccttt

SEQ ID NO: 2250 - DNA, 21 bp, Artificial Sequence
  Synthetic Oligonucleotide
agctccctgttgcatggactt

SEQ ID NO: 2251 - DNA, 20 bp, Artificial Sequence
  Synthetic Oligonucleotide
gggtagagggaaaagggttc

SEQ ID NO: 2252 - DNA, 29 bp, Artificial Sequence
  Synthetic Oligonucleotide
caaaggctgaactggattcttaaccaaga

SEQ ID NO: 2253 - DNA, 21 bp, Artificial Sequence
  Synthetic Oligonucleotide
tgcaccaccattgctattatt

SEQ ID NO: 2254 - DNA, 20 bp, Artificial Sequence
  Synthetic Oligonucleotide
gatacatcgtctgcgaggaa

SEQ ID NO: 2255 - DNA, 24 bp, Artificial Sequence
  Synthetic Oligonucleotide
ttcaaagacgtgctcctgactgcc

SEQ ID NO: 2256 - DNA, 20 bp, Artificial Sequence
  Synthetic Oligonucleotide
ctttcaatgactgcctgctc

SEQ ID NO: 2257 - DNA, 18 bp, Artificial Sequence
  Synthetic Oligonucleotide
ggagatgaagcccccaag

SEQ ID NO: 2258 - DNA, 24 bp, Artificial Sequence
  Synthetic Oligonucleotide
agaagcaaccccagaccaaaacca

SEQ ID NO: 2259 - DNA, 18 bp, Artificial Sequence
  Synthetic Oligonucleotide
gtccagctgcctgagtgg

SEQ ID NO: 2260 - DNA, 25 bp, Artificial Sequence
  Synthetic Oligonucleotide
agactgtggagtttgatgttgttga

SEQ ID NO: 2261 - DNA, 23 bp, Artificial Sequence
  Synthetic Oligonucleotide
ttgctgcctccgcacccttttct

SEQ ID NO: 2262 - DNA, 22 bp, Artificial Sequence
  Synthetic Oligonucleotide
ggaacaccaccaggacctgtaa

SEQ ID NO: 2263 - DNA, 18 bp, Artificial Sequence
  Synthetic Oligonucleotide
catggcctccgctatgaa

SEQ ID NO: 2264 - DNA, 24 bp, Artificial Sequence
  Synthetic Oligonucleotide
aggttcattcagctctgtcaccgc

SEQ ID NO: 2265 - DNA, 22 bp, Artificial Sequence
  Synthetic Oligonucleotide
ggagatttcgatcttcattgga

SEQ ID NO: 2266 - DNA, 18 bp, Artificial Sequence
  Synthetic Oligonucleotide
ctgcgttcacaccccagt

SEQ ID NO: 2267 - DNA, 24 bp, Artificial Sequence
  Synthetic Oligonucleotide
tctctccagaacagctcgccctgt

SEQ ID NO: 2268 - DNA, 19 bp, Artificial Sequence
  Synthetic Oligonucleotide
ctcagccacgacagatggt

SEQ ID NO: 2269 - DNA, 19 bp, Artificial Sequence
  Synthetic Oligonucleotide
tgctgagcctcctctcctt

SEQ ID NO: 2270 - DNA, 24 bp, Artificial Sequence
  Synthetic Oligonucleotide
tactcctcatcacagtgcccctgc

SEQ ID NO: 2271 - DNA, 21 bp, Artificial Sequence
  Synthetic Oligonucleotide
ggatgggggttagtgataagg

SEQ ID NO: 2272 - DNA, 78 bp, Artificial Sequence
  Synthetic Oligonucleotide
cgttccgatcctctatactgcatcccaggcatgcctacagcaccctgatgtcgcagcctataaggccaacagggacct

SEQ ID NO: 2273 - DNA, 77 bp, Artificial Sequence
  Synthetic Oligonucleotide
aaacaccactggagcattgactaccaggctcgccaatgatgctgctcaagttaaaggggctataggttccaggcttg

SEQ ID NO: 2274 - DNA, 76 bp, Artificial Sequence
  Synthetic Oligonucleotide
tgcagactgtaccatgctgaccattgcccatcgcctgcacacggttctaggctccgataggattatggtgctggcc

SEQ ID NO: 2275 - DNA, 71 bp, Artificial Sequence
  Synthetic Oligonucleotide
ggatgaacctcgacctgctgcaggagcactcggacgaggctatctgggcagccctggagacggtgcagctc

SEQ ID NO: 2276 - DNA, 69 bp, Artificial Sequence
  Synthetic Oligonucleotide
gctaccaagtccgtgctgtttgtgtgtctgggtaacatttgtcgatcacccattgcagaagcagttttc

SEQ ID NO: 2277 - DNA, 67 bp, Artificial Sequence
  Synthetic Oligonucleotide
cccatcaacttgtgccagtacagggtctgtgcagtggagtaggcacttcagtggtcgaaccatcacc

SEQ ID NO: 2278 - DNA, 73 bp, Artificial Sequence
  Synthetic Oligonucleotide
gaagtgccaggaggcgattaatgctacttgcaaaggcgtgtcctactgcacaggtaatagcagtgagtgcccg

SEQ ID NO: 2279 - DNA, 66 bp, Artificial Sequence
  Synthetic Oligonucleotide
ggagaagggtggagtgcagcacccagatggattctgactgtgcggccatccagagacctgaccctg

SEQ ID NO: 2280 - DNA, 76 bp, Artificial Sequence
  Synthetic Oligonucleotide
ttgacaacctgctggacatcgaggtggcctacagtctgctcaggggagggtctgatgatagcagcaaggatcccat

SEQ ID NO: 2281 - DNA, 66 bp, Artificial Sequence
  Synthetic Oligonucleotide
cttttccctccagtggcacctcctggaaacagtccacttgggcgcaaaacccagtgccttccaaat

SEQ ID NO: 2282 - DNA, 75 bp, Artificial Sequence
  Synthetic Oligonucleotide
tagagagcccctgacaatcctgaggcttcatcaggagctagagccatttaacatttcctctttccaagaccaacc

SEQ ID NO: 2283 - DNA, 71 bp, Artificial Sequence
  Synthetic Oligonucleotide
cgcttctatggcgctgagattgtgtcagccctggactacctgcactcggagaagaacgtggtgtaccggga

SEQ ID NO: 2284 - DNA, 71 bp, Artificial Sequence
  Synthetic Oligonucleotide
tcctgccacccttcaaacctcaggtcacgtccgaggtcgacacaaggtacttcgatgatgaatttaccgcc

SEQ ID NO: 2285 - DNA, 75 bp, Artificial Sequence
  Synthetic Oligonucleotide
ttgtctctgccttggactatctacattccggaaagattgtgtaccgtgatctcaagttggagaatctaatgctgg

SEQ ID NO: 2286 - DNA, 67 bp, Artificial Sequence
  Synthetic Oligonucleotide
caagaagaggctctaccctgggactgggaatttccaaggccacctttgaggatcgcagagctcattt

SEQ ID NO: 2287 - DNA, 66 bp, Artificial Sequence
  Synthetic Oligonucleotide
gaggaatatggaatccaagggggccagttcctgccgtctgctcttctgcctcttgatctccgccac

SEQ ID NO: 2288 - DNA, 74 bp, Artificial Sequence
  Synthetic Oligonucleotide
gaaggagataaggaggatgttgacaaggcagtgaaggccgcaagacaggcttttcagattggatctccgtggcg

SEQ ID NO: 2289 - DNA, 69 bp, Artificial Sequence
  Synthetic Oligonucleotide
gcctgtacgtgccagctccccgactgccagagcctcaactgtctctgcttcgagatcaagctccgatga

SEQ ID NO: 2290 - DNA, 76 bp, Artificial Sequence
  Synthetic Oligonucleotide
gatggttcagctctgcaaggatcgatttgaatatctttccttctcgcccaccacgccgatgagcagccacggtcga

SEQ ID NO: 2291 - DNA, 69 bp, Artificial Sequence
  Synthetic Oligonucleotide
ccgtgaaagctgctctgtaaaagctgacacagccctcccaagtgagcaggactgttcttcccactgcaa

SEQ ID NO: 2292 - DNA, 67 bp, Artificial Sequence
  Synthetic Oligonucleotide
ctccaggtgtacctccaaccctagccttctcccacagctgcctacaacagagtctcccagccttctc

SEQ ID NO: 2293 - DNA, 67 bp, Artificial Sequence
  Synthetic Oligonucleotide
gcccctatcctaccttcaatccatcctcggatgtcgctgccttgcataaggccataatggttaaagg

SEQ ID NO: 2294 - DNA, 71 bp, Artificial Sequence
  Synthetic Oligonucleotide
caagacactaagggcgactaccagaaagcgctgctgtacctgtgtggtggagatgactgaagcccgacacg

SEQ ID NO: 2295 - DNA, 67 bp, Artificial Sequence
  Synthetic Oligonucleotide
gctcaagcctggaagatgacgtggtgggggacacttcagggtactaccagcggatgttggtggttct

SEQ ID NO: 2296 - DNA, 81 bp, Artificial Sequence
  Synthetic Oligonucleotide
gactgcaaagatggaaacgaccttctatgacgatgccctcaacgcctcgttcctcccgtccgagagcggaccttatggcta

SEQ ID NO: 2297 - DNA, 69 bp, Artificial Sequence
  Synthetic Oligonucleotide
ggacagcaggaatgtgtttctccatacaggtcacggggagccaatggttcagaaacaaatcgagtgggt

SEQ ID NO: 2298 - DNA, 68 bp, Artificial Sequence
  Synthetic Oligonucleotide
gatgaagcctttcgcaagttcctgaagggcctggcttcccgaaagccccttgtgctgtgtggagacct

SEQ ID NO: 2299 - DNA, 67 bp, Artificial Sequence
  Synthetic Oligonucleotide
accccggcctgtatatcattgggatcaagaactcgagccattggaaatgcagcaaagagccagatag

SEQ ID NO: 2300 - DNA, 83 bp, Artificial Sequence
  Synthetic Oligonucleotide
ccaccttggaccaaagtaaagcgtggaatcgttaccgcctccccaacacgctgaaacccgattcctaccaggtgacgctgaga

SEQ ID NO: 2301 - DNA, 74 bp, Artificial Sequence
  Synthetic Oligonucleotide
ggaaacacactggaggacaaggctcgggaactcatcagccgcatcaaacagagtgaactttctgccaagatgcg

SEQ ID NO: 2302 - DNA, 82 bp, Artificial Sequence
  Synthetic Oligonucleotide
tgtgagtgaaatgccttctagtagtgaaccgtcctcgggagccgactatgactactcagaagagtatgataacgaaccacaa

SEQ ID NO: 2303 - DNA, 80 bp, Artificial Sequence
  Synthetic Oligonucleotide
cgcagtgcagctgagtatctgctcagcagtctaatcaatggcagcttcctggtgcgagaaagtgagagtagccctgggca

SEQ ID NO: 2304 - DNA, 74 bp, Artificial Sequence
  Synthetic Oligonucleotide
actggcccacttagtcctcaagctcccaacctgctgtccctcaagccccgcttctaccagcctgtggagttcag

SEQ ID NO: 2305 - DNA, 66 bp, Artificial Sequence
  Synthetic Oligonucleotide
gcagccacctgcaactttgcaggcgagagagcatcccgtctacccgcctgagctgtccctcctgga

SEQ ID NO: 2306 - DNA, 65 bp, Artificial Sequence
  Synthetic Oligonucleotide
gatgctgccactcaacaacttttgagtcgtggcgtgcgtctaactgagttgctgaagcaaggaca

SEQ ID NO: 2307 - DNA, 66 bp, Artificial Sequence
  Synthetic Oligonucleotide
ccgctttcgctacagcatggtggcctactggagacaggctggactcagctacatccgatactccca

SEQ ID NO: 2308 - DNA, 67 bp, Artificial Sequence
  Synthetic Oligonucleotide
agctgcagaagagctgcacatttgacgagcagcgaacagccacgatcatggaggagttggcagatgc

SEQ ID NO: 2309 - DNA, 66 bp, Artificial Sequence
  Synthetic Oligonucleotide
ggctatgtctttgcaccagccaccagcgccaacgacagtgagatatccagtgatgcgctgacggat

SEQ ID NO: 2310 - DNA, 68 bp, Artificial Sequence
  Synthetic Oligonucleotide
ccgtgtgacagcatcgttgtggcgtactacttctgcggggaacccatcccctaccgcaccctggtgag

SEQ ID NO: 2311 - DNA, 80 bp, Artificial Sequence
  Synthetic Oligonucleotide
ggctcttgtgcgtactgtccttcgggctggtgacagggaagacatcactgagcctgccatctgtgctcttcgtcatctga

SEQ ID NO: 2312 - DNA, 73 bp, Artificial Sequence
  Synthetic Oligonucleotide
gggtcaggtgcctcgagatcgggcttgggcccagagcatgttccagatcccagagtttgagccgagtgagcag

SEQ ID NO: 2313 - DNA, 81 bp, Artificial Sequence
  Synthetic Oligonucleotide
cgttgtcagcacttggaatacaagatggttgccgggtcatgttaattgggaaaaagaacagtccacaggaagaggttgaac

SEQ ID NO: 2314 - DNA, 69 bp, Artificial Sequence
  Synthetic Oligonucleotide
ctaggggcaaaaagcatgactgctttttcctgtctggcatggaatcacgcagtcaccttgggcatttag

SEQ ID NO: 2315 - DNA, 74 bp, Artificial Sequence
  Synthetic Oligonucleotide
gaaagtaagccaggcccagttggaccagaactccctcctggacacatcccaattcaagtgatccgcaaagaggt

SEQ ID NO: 2316 - DNA, 66 bp, Artificial Sequence
  Synthetic Oligonucleotide
ccattcccaccattctacctgaggccaggacgtctggggtgtggggattggtgggtctatgttccc

SEQ ID NO: 2317 - DNA, 70 bp, Artificial Sequence
  Synthetic Oligonucleotide
ccgccgtggacacagactccccccgagaggtctttttccgagtggcagctgacatgttttctgacggcaa

SEQ ID NO: 2318 - DNA, 83 bp, Artificial Sequence
  Synthetic Oligonucleotide
cctggagggtcctgtacaatctcatcatgggactcctgcccttacccaggggccacagagcccccgagatggagcccaattag

SEQ ID NO: 2319 - DNA, 73 bp, Artificial Sequence
  Synthetic Oligonucleotide
ccccgagacaacggagataagtgctgttgcggatgccaacggaaagaatcttgggaaagaggccaaacccgag

SEQ ID NO: 2320 - DNA, 73 bp, Artificial Sequence
  Synthetic Oligonucleotide
cagatggacctagtacccactgagatttccacgccgaaggacagcgatgggaaaaatgcccttaaatcatagg

SEQ ID NO: 2321 - DNA, 73 bp, Artificial Sequence
  Synthetic Oligonucleotide
gctgggatggcttttgtcacttcttcaggaccccctttccactggctttttggagaaaacagctggtccaggc

SEQ ID NO: 2322 - DNA, 69 bp, Artificial Sequence
  Synthetic Oligonucleotide
aattaccaagcagccgaagaccacccacgaatggttatcttacgactgttacgttacattgtccgcctg

SEQ ID NO: 2323 - DNA, 73 bp, Artificial Sequence
  Synthetic Oligonucleotide
aacccacccctgtcttggagctccgggtagctctcaaactcgaggctgcgcaccccctttcccgtcagctgag

SEQ ID NO: 2324 - DNA, 70 bp, Artificial Sequence
  Synthetic Oligonucleotide
cttttgtggaactctatgggaacaatgcagcagccgagagccgaaagggccaggaacgcttcaaccgctg

SEQ ID NO: 2325 - DNA, 74 bp, Artificial Sequence
  Synthetic Oligonucleotide
tgtactggcgaagaatatttggtaaagcagggcatcgatctctcaccctggggcttgtggaagaatcacgtggc

SEQ ID NO: 2326 - DNA, 77 bp, Artificial Sequence
  Synthetic Oligonucleotide
ccaggaagaatgcttaagatgtgagtggatggatctcaatgacctggcgaagactgaaaatacaactcccatcacca

SEQ ID NO: 2327 - DNA, 66 bp, Artificial Sequence
  Synthetic Oligonucleotide
gagctccgcaaggatgacttcaagggtctccagcacctctacgccctcgtcctggtgaacaacaag

SEQ ID NO: 2328 - DNA, 71 bp, Artificial Sequence
  Synthetic Oligonucleotide
ggactgtgaggtcaacaacggttccagcctcagggatgagtgcatcacaaacctactggtgtttggcttcc

SEQ ID NO: 2329 - DNA, 70 bp, Artificial Sequence
  Synthetic Oligonucleotide
attcctatggctctgcaattgtcaccggttaactgtggcctgtgcccaggaagagccattcactcctgcc

SEQ ID NO: 2330 - DNA, 76 bp, Artificial Sequence
  Synthetic Oligonucleotide
cctgcaaaagggaacaagagcccttcgcctccagatggctcccctgccgccacccccgagatcagagtcaaccacg

SEQ ID NO: 2331 - DNA, 77 bp, Artificial Sequence
  Synthetic Oligonucleotide
ggttgctgcctccatcaaagatggagaggctgtgtggtttggctgtgatgttggaaaacacttcaatagcaagctgg

SEQ ID NO: 2332 - DNA, 77 bp, Artificial Sequence
  Synthetic Oligonucleotide
atgtggacgctctttcaatggacgtgtccccgcgtgcttcttagacggactgcggtctcctaaaggtcgaccatggt

SEQ ID NO: 2333 - DNA, 69 bp, Artificial Sequence
  Synthetic Oligonucleotide
gggctagccattgaggtgactcacctccatcagactcggacccaccagggccagcatgtcaggattagc

SEQ ID NO: 2334 - DNA, 69 bp, Artificial Sequence
  Synthetic Oligonucleotide
tcgtggaacatgacaaggaattcttccacccacgctaccaccatcgagagttccggtttgatctttcca

SEQ ID NO: 2335 - DNA, 68 bp, Artificial Sequence
  Synthetic Oligonucleotide
ttggttcagcgaactattgccaaacagattcagatggtccggcaagttggtaaaggccgatatggaga

SEQ ID NO: 2336 - DNA, 82 bp, Artificial Sequence
  Synthetic Oligonucleotide
ccttccgaccagcagatgaagatcatcgaaatcaatttgggcaacgagaccgatcctcatcagctcccaatgtgcatataaa

SEQ ID NO: 2337 - DNA, 65 bp, Artificial Sequence
  Synthetic Oligonucleotide
tcagggggctagaaatctgttgctatgggcccttcaccaacatgcccacagatcaactggaatgg

SEQ ID NO: 2338 - DNA, 70 bp, Artificial Sequence
  Synthetic Oligonucleotide
agttcgtgctttgcaagatggtgcagagctttatgaagcagtgaagaatgcagcagacccagcttacctt

SEQ ID NO: 2339 - DNA, 79 bp, Artificial Sequence
  Synthetic Oligonucleotide
gtgcaggaaaggttcacaaatgtggagtgtctgcgtccaatacacgcgtgtgctcctctccttactccatcgtgtgtgc

SEQ ID NO: 2340 - DNA, 74 bp, Artificial Sequence
  Synthetic Oligonucleotide
cagtgatccactttaacaaccctaaagttcaggcatctctggcagcgaacactttcaccattacaggccatgct

SEQ ID NO: 2341 - DNA, 63 bp, Artificial Sequence
  Synthetic Oligonucleotide
gttgggacacagttggtctgcagtcggcccaggacggtctactcagcacaactgactgcttca

SEQ ID NO: 2342 - DNA, 68 bp, Artificial Sequence
  Synthetic Oligonucleotide
ccgaggttaatccagcacgtatggggccaagtgtaggctcccagcaggaactgagagcgccatgtctt

SEQ ID NO: 2343 - DNA, 82 bp, Artificial Sequence
  Synthetic Oligonucleotide
tcaacagaaggctgaaccactagaaagactacagtcccagcaccgacaattccaagctcgagtgtctcggcaaactctgttg

SEQ ID NO: 2344 - DNA, 73 bp, Artificial Sequence
  Synthetic Oligonucleotide
ctgaagcagatggttcatcatttcctgggctgttaaacaaagcgaggttaaggttagactcttgggaatcagc

SEQ ID NO: 2345 - DNA, 75 bp, Artificial Sequence
  Synthetic Oligonucleotide
ccatctcgctgagatacgaagggagggtgtaccattacaggatcaacactgcttctgatggcaagctctacgtct

SEQ ID NO: 2346 - DNA, 75 bp, Artificial Sequence
  Synthetic Oligonucleotide
gaggcaactgcttatggcttaattaagtcagatgcggccatgactgtcgctgtaaagatgctcaagccgagtgcc

SEQ ID NO: 2347 - DNA, 87 bp, Artificial Sequence
  Synthetic Oligonucleotide
aactcagacttggaaatgccttctttaacttccacccccctcattggtcacaaattgactgttacaacaccatttcatagagaccag

SEQ ID NO: 2348 - DNA, 74 bp, Artificial Sequence
  Synthetic Oligonucleotide
tgaggagtggtattttggcaagatcaccagacgggagtcagagcggttactgctcaatgcagagaacccgagag

SEQ ID NO: 2349 - DNA, 65 bp, Artificial Sequence
  Synthetic Oligonucleotide
tcagctgtgagctgcggataccgcccggcaatgggacctgctcttaacctcaaacctaggaccgt

SEQ ID NO: 2350 - DNA, 67 bp, Artificial Sequence
  Synthetic Oligonucleotide
ccagcactgctcgttactgtctgccttcagtggtctgaggtcccagtatgaactgccgtgaagtcaa

SEQ ID NO: 2351 - DNA, 67 bp, Artificial Sequence
  Synthetic Oligonucleotide
ctacgagtcagcccatccatccatggctaccacttcgacacagcctctcgtaagaaagccgtgggca

SEQ ID NO: 2352 - DNA, 72 bp, Artificial Sequence
  Synthetic Oligonucleotide
atcctagccctggtttttggcctcctttttgctgtcaccagcgtcgcgttccttgtgcagatgagaaggcag

SEQ ID NO: 2353 - DNA, 77 bp, Artificial Sequence
  Synthetic Oligonucleotide
gaaggccaagaaccgagtcaaattatattccagtttaaggccaatcctcctgctgtgacttttgaactaactgggga

SEQ ID NO: 2354 - DNA, 78 bp, Artificial Sequence
  Synthetic Oligonucleotide
cactaaggtttgagacagttccagaaagaacccaagctcaagacgcaggacgagctcagttgtagagggctaattcgc

SEQ ID NO: 2355 - DNA, 68 bp, Artificial Sequence
  Synthetic Oligonucleotide
gattgtcactgatggggaggagcctgctgagatgatccaggtcctgggccccaagcctgctctgaagg

SEQ ID NO: 2356 - DNA, 79 bp, Artificial Sequence
  Synthetic Oligonucleotide
caagaagctgtacgagctcatcatcacccgctactcggagcccgacctggcggtcgactttgacaatttcgtttgctgc

SEQ ID NO: 2357 - DNA, 70 bp, Artificial Sequence
  Synthetic Oligonucleotide
cctcggggatactgtctgatcatcaacaatcacaattttgcaaaagcacgggagaaagtgcccaaacttc

SEQ ID NO: 2358 - DNA, 77 bp, Artificial Sequence
  Synthetic Oligonucleotide
tgaatgccgtggattgcacgtggcctcttgagcagtggctggtccagggctagtgacttgtgtcccatgatccctgt

SEQ ID NO: 2359 - DNA, 78 bp, Artificial Sequence
  Synthetic Oligonucleotide
atccattcgatctcaccaaggtttggcctcacaaggactaccctctcatcccagttggtaaactggtcttaaaccgga

SEQ ID NO: 2360 - DNA, 74 bp, Artificial Sequence
  Synthetic Oligonucleotide
gtggctcaacattgtgttcccatttcagctgatcagtgggcctccaaggaggggctgtaaaatggaggccattg

SEQ ID NO: 2361 - DNA, 72 bp, Artificial Sequence
  Synthetic Oligonucleotide
tcattcacaaacctggcagttatatcttccggctgagctgtactcgtctgggtcagtgggctattgggtatg

SEQ ID NO: 2362 - DNA, 69 bp, Artificial Sequence
  Synthetic Oligonucleotide
ccatgtgctgtaccaagagtttgctcctggctgctttgatgtcagtgctgctactccacctctgcggcg

SEQ ID NO: 2363 - DNA, 77 bp, Artificial Sequence
  Synthetic Oligonucleotide
agcagacagtggtcagtcctttcttggctctgctgacactcgagcccacattccgtcacctgctcagaatcatgcag

SEQ ID NO: 2364 - DNA, 79 bp, Artificial Sequence
  Synthetic Oligonucleotide
ccatacctcaagtatttgccatcagttattgctggagctgcctttcatttagcactctacacagtcacgggacaaagct

SEQ ID NO: 2365 - DNA, 84 bp, Artificial Sequence
  Synthetic Oligonucleotide
ttcaggttgttgcaggagaccatgtacatgactgtctccattattgatcggttcatgcagaataattgtgtgcccaagaagatg

SEQ ID NO: 2366 - DNA, 73 bp, Artificial Sequence
  Synthetic Oligonucleotide
aggcttctgcaggagactctgtacatgtgcgttggcattatggatcgatttttacaggttcagccagtttccc

SEQ ID NO: 2367 - DNA, 69 bp, Artificial Sequence
  Synthetic Oligonucleotide
gcatgttcgtggcctctaagatgaaggagaccatccccctgacggccgagaagctgtgcatctacaccg

SEQ ID NO: 2368 - DNA, 76 bp, Artificial Sequence
  Synthetic Oligonucleotide
cctctgtgctacagattatacctttgccatgtacccgccatccatgatcgccacgggcagcattggggctgcagtg

SEQ ID NO: 2369 - DNA, 71 bp, Artificial Sequence
  Synthetic Oligonucleotide
aaagaagatgatgaccgggtttacccaaactcaacgtgcaagcctcggattattgcaccatccagaggctc

SEQ ID NO: 2370 - DNA, 82 bp, Artificial Sequence
  Synthetic Oligonucleotide
atgctgtggctccttcctaactggggctttcttgacatgtaggttgcttggtaataacctttttgtatatcacaatttgggt

SEQ ID NO: 2371 - DNA, 85 bp, Artificial Sequence
  Synthetic Oligonucleotide
ggtcaccaagaaacatcagtatgaaattaggaattgttggccacctgtattatctggggggatcagtccttgcattatcattgaa

SEQ ID NO: 2372 - DNA, 64 bp, Artificial Sequence
  Synthetic Oligonucleotide
ggatgacatgcactcagctcttggctccactgggatgggaggagaggacaagggaaatgtcagg

SEQ ID NO: 2373 - DNA, 75 bp, Artificial Sequence
  Synthetic Oligonucleotide
gcaggtgtcagcaagtatgatcagcaatgaggcggtggtcaatatcctgtcgagctcatcaccacagcggaaaaa

SEQ ID NO: 2374 - DNA, 72 bp, Artificial Sequence
  Synthetic Oligonucleotide
gcccagtgcggagaacaggtccagcttgattctcgtctctgcacttaagctgttctccaggtgcgtgtgatt

SEQ ID NO: 2375 - DNA, 81 bp, Artificial Sequence
  Synthetic Oligonucleotide
cgtcaggacccaccatgtctgccccatcacgcggccgagacatggcttggccacagctcttgaggatgtcaccaattaacc

SEQ ID NO: 2376 - DNA, 77 bp, Artificial Sequence
  Synthetic Oligonucleotide
tccaactaatgccaccaccaaggcggctggtggtgccctgcagtcaacagccagtctcttcgtggtctcactctctc

SEQ ID NO: 2377 - DNA, 66 bp, Artificial Sequence
  Synthetic Oligonucleotide
tgtgaaagggaaacacctttgtccaagtcccctatttcccggaccttctaagcccttttgggtgct

SEQ ID NO: 2378 - DNA, 75 bp, Artificial Sequence
  Synthetic Oligonucleotide
tgtatttcaagacctctgtgcacttatttatgaacctgccctgctcccacagaacacagcaattcctcaggctaa

SEQ ID NO: 2379 - DNA, 67 bp, Artificial Sequence
  Synthetic Oligonucleotide
ccactgcacacacctcagaggctgttcttggggccctacaccttgaggaggggcaggtaaactcctg

SEQ ID NO: 2380 - DNA, 65 bp, Artificial Sequence
  Synthetic Oligonucleotide
agatgaagtggaaggcgcttttcaccgcggccatcctgcaggcacagttgccgattacagaggca

SEQ ID NO: 2381 - DNA, 90 bp, Artificial Sequence
  Synthetic Oligonucleotide
atcaccgacagcacagacagaatccctgctaccaatatggactccagtcatagtacaacgcttcagcctactgcaaatccaaacacaggt

SEQ ID NO: 2382 - DNA, 78 bp, Artificial Sequence
  Synthetic Oligonucleotide
gacgaagacagtccctggatcaccgacagcacagacagaatccctgctaccagagaccaagacacattccaccccagt

SEQ ID NO: 2383 - DNA, 69 bp, Artificial Sequence
  Synthetic Oligonucleotide
cacacaaaacagaaccaggactggacccagtggaacccaagccattcaaatccggaagtgctacttcag

SEQ ID NO: 2384 - DNA, 78 bp, Artificial Sequence
  Synthetic Oligonucleotide
ctcataccagccatccaatgcaaggaaggacaacaccaagcccagaggacagttcctggactgatttcttcaacccaa

SEQ ID NO: 2385 - DNA, 74 bp, Artificial Sequence
  Synthetic Oligonucleotide
tggttcccagccctgtgtccacctccaagcccagattcagattcgagtcatgtacacaacccagggtggaggag

SEQ ID NO: 2386 - DNA, 71 bp, Artificial Sequence
  Synthetic Oligonucleotide
ttcagttgctttgcaggaagtgtctagaggaatatggtgggcacagaagtagctctggtgaccttgatcaa

SEQ ID NO: 2387 - DNA, 84 bp, Artificial Sequence
  Synthetic Oligonucleotide
gtgcaggctcaggtgaagtgctgcggctgggtcagcttctacaactggacagacaacgctgagctcatgaatcgccctgaggtc

SEQ ID NO: 2388 - DNA, 68 bp, Artificial Sequence
  Synthetic Oligonucleotide
agggtgaggtgcttgagtctccaacggcaagggaacaagtacttcttgatacctgggatactgtgccc

SEQ ID NO: 2389 - DNA, 64 bp, Artificial Sequence
  Synthetic Oligonucleotide
gggcgtggaacagtttatctcagacatctgccccaagaaggacgtactcgaaaccttcaccgtg

SEQ ID NO: 2390 - DNA, 68 bp, Artificial Sequence
  Synthetic Oligonucleotide
gagagcgacgcggttgttgtagctgccgctgcggccgccgcggaataataagccgggatctaccatac

SEQ ID NO: 2391 - DNA, 68 bp, Artificial Sequence
  Synthetic Oligonucleotide
tggattggagttctgggaatgtactggccgtggcactggacaacagtgtgtacctgtggagtgcaagc

SEQ ID NO: 2392 - DNA, 71 bp, Artificial Sequence
  Synthetic Oligonucleotide
tcttgctggctacgcctcttctgtccctgttagacgtcctccgtccatatcagaactgtgccacaatgcag

SEQ ID NO: 2393 - DNA, 85 bp, Artificial Sequence
  Synthetic Oligonucleotide
aaacgagcagtttgccatcagacgcttccagtctatgccggtgaggctgctgggccacagccccgtgcttcggaacatcaccaac

SEQ ID NO: 2394 - DNA, 67 bp, Artificial Sequence
  Synthetic Oligonucleotide
ggtgagcagaagtggcctatatcgctccccgtcgatgccagagaacttgaacaggccaagactgaag

SEQ ID NO: 2395 - DNA, 77 bp, Artificial Sequence
  Synthetic Oligonucleotide
gcagtccgctgtgttcaatatgatggcaggagggttgttagtggagcatatgattttatggtaaaggtgtgggatcc

SEQ ID NO: 2396 - DNA, 72 bp, Artificial Sequence
  Synthetic Oligonucleotide
tccagagactgctgaaaagctggcccgtgacctgaaggctgtcaagtatgtggagtgttctgcacttacaca

SEQ ID NO: 2397 - DNA, 67 bp, Artificial Sequence
  Synthetic Oligonucleotide
gagctgaaagacgcacactgtcagaggaaactggccatgcaggaattcatggagatcaatgagcggc

SEQ ID NO: 2398 - DNA, 67 bp, Artificial Sequence
  Synthetic Oligonucleotide
gcaacactccccatttacctccttgttctccaccaaagcaaggcaagaaagagaatggtccccctca

SEQ ID NO: 2399 - DNA, 71 bp, Artificial Sequence
  Synthetic Oligonucleotide
aagaccgtggatggctacatgaatgaagatgacctgcccagaagccgtcgctccagatcatccgtgaccct

SEQ ID NO: 2400 - DNA, 81 bp, Artificial Sequence
  Synthetic Oligonucleotide
tgagtgtcccccggtatcttccccgccctgccaatcccgatgaaattggaaattttattgatgaaaatctgaaagcggctg

SEQ ID NO: 2401 - DNA, 70 bp, Artificial Sequence
  Synthetic Oligonucleotide
gtcggcagaagcaggacttgtaccttctgcccatagtgatcagcgatggcggcatcccgcccatgagtag

SEQ ID NO: 2402 - DNA, 71 bp, Artificial Sequence
  Synthetic Oligonucleotide
acccatgtaccgtcctcggccagccaacccagatgaaatcggcaactttataattgagaacctgaaggcgg

SEQ ID NO: 2403 - DNA, 78 bp, Artificial Sequence
  Synthetic Oligonucleotide
aatgctgcactacgaccctaacaagcggatttcggccaaggcagccctggctcaccctttcttccaggatgtgaccaa

SEQ ID NO: 2404 - DNA, 66 bp, Artificial Sequence
  Synthetic Oligonucleotide
agcaacaccagcctcctggccacctcctctccaatgcctgtgaaagaggagtttctgccatagccc

SEQ ID NO: 2405 - DNA, 67 bp, Artificial Sequence
  Synthetic Oligonucleotide
gggcaggcaaggtttacactgcggaagccaaaggcagctaagatagaaagctggactgaccaaagac

SEQ ID NO: 2406 - DNA, 71 bp, Artificial Sequence
  Synthetic Oligonucleotide
acttgcctgttcagagcactcattccttcccacccccagtcctgtcctatcactctaattcggatttgcca

SEQ ID NO: 2407 - DNA, 72 bp, Artificial Sequence
  Synthetic Oligonucleotide
cacagcctcacttctaaccttctggaacccacccaccactgccaagctcactattgaatccacgccattcaa

SEQ ID NO: 2408 - DNA, 65 bp, Artificial Sequence
  Synthetic Oligonucleotide
gcaacccacgtgtaactgtcagccgggccctgagtaatcgcttaaagatgttcctacgggcttgt

SEQ ID NO: 2409 - DNA, 77 bp, Artificial Sequence
  Synthetic Oligonucleotide
tgacaatcagcacacctgcattcaccgctcggaagagggcctgagctgcatgaataaggatcacggctgtagtcaca

SEQ ID NO: 2410 - DNA, 63 bp, Artificial Sequence
  Synthetic Oligonucleotide
taaattcactcgtggtgtggacttcaattggcaagcccaggccctattggccctacaagaggc

SEQ ID NO: 2411 - DNA, 83 bp, Artificial Sequence
  Synthetic Oligonucleotide
ggatgctggtgacctcttcttccctcacgttgcaacaggaattaaaggctaaaagaaaacgaagagttacttggtgccttggc

SEQ ID NO: 2412 - DNA, 68 bp, Artificial Sequence
  Synthetic Oligonucleotide
ctcccgtcaacagcgttctttccaaacactggaccaggagtgcatccagatgaaggccagactcaccc

SEQ ID NO: 2413 - DNA, 77 bp, Artificial Sequence
  Synthetic Oligonucleotide
actttgcgagaaatgggaaccccaatggcgagggtctgccacactggccgctgttcgaccaggaggagcaatacctg

SEQ ID NO: 2414 - DNA, 76 bp, Artificial Sequence
  Synthetic Oligonucleotide
ctgaaggagctccaagacctcgctctccaaggcgccaaggagagggcacatcagcagaagaaacacagcggttttg

SEQ ID NO: 2415 - DNA, 80 bp, Artificial Sequence
  Synthetic Oligonucleotide
ccaccataggcagaggcaggccttcctacaccctactccctgtgcctccagcctcgactagtccctagcactcgacgact

SEQ ID NO: 2416 - DNA, 72 bp, Artificial Sequence
  Synthetic Oligonucleotide
gaggccagtggtggaaacaggtgtggagctgatgagtctgccctaccgcctggtgtttgctgtggcctcgga

SEQ ID NO: 2417 - DNA, 71 bp, Artificial Sequence
  Synthetic Oligonucleotide
ctctgtgcgaggctgtcagccacactaggtatcagggatcccgagatgggtaccagcccacagtccttacc

SEQ ID NO: 2418 - DNA, 76 bp, Artificial Sequence
  Synthetic Oligonucleotide
aaggaagtggtccctctgtggcaagtgatgaagtctccagctttgcctcagctctcccagacagaaagactgcgtc

SEQ ID NO: 2419 - DNA, 82 bp, Artificial Sequence
  Synthetic Oligonucleotide
gataaattggtacaagggatcagcttttcccagcccacatgtcctgatcatatgcttttgaatagtcagttacttggcaccc

SEQ ID NO: 2420 - DNA, 78 bp, Artificial Sequence
  Synthetic Oligonucleotide
atgtggaacccccacctacttggcgcctgaagttcttgtttctgttgggactgctgggtataaccgtgctgtggactg

SEQ ID NO: 2421 - DNA, 72 bp, Artificial Sequence
  Synthetic Oligonucleotide
tgcctgtggtgggaagctcagtaactgggaaccaaaggatgatgctatgtcagaacaccggaggcattttcc

SEQ ID NO: 2422 - DNA, 86 bp, Artificial Sequence
  Synthetic Oligonucleotide
ggatatttccgtggctcttattcaaactctccatcaaatcctgtaaactccagagcaaatcaagatttttctgccttgatgagaag

SEQ ID NO: 2423 - DNA, 78 bp, Artificial Sequence
  Synthetic Oligonucleotide
ggtccctaaaacccatctgatgtctgaatctgaatggaggaatcttggcgttcagcagagtcagggatgggtccatta

SEQ ID NO: 2424 - DNA, 62 bp, Artificial Sequence
  Synthetic Oligonucleotide
ggctggacgtggttttgtctgctgcgcccgctcttcgcgctctcgtttcattttctgcagcg

SEQ ID NO: 2425 - DNA, 72 bp, Artificial Sequence
  Synthetic Oligonucleotide
ggctgctttgctgcaactgtccaccccgcacagacaagccttactccgccaagtattctgctgcccgctctg

SEQ ID NO: 2426 - DNA, 73 bp, Artificial Sequence
  Synthetic Oligonucleotide
tctgggaggtgccctactttgctgttcctgtccccgaaaaacaacctcttacccaacaccaaggccctatcca

SEQ ID NO: 2427 - DNA, 74 bp, Artificial Sequence
  Synthetic Oligonucleotide
ggtctgccctagtcatcctgggaggtgcactgctctcctgttcctgtcctgggaatgagagcaaggctgggtac

SEQ ID NO: 2428 - DNA, 68 bp, Artificial Sequence
  Synthetic Oligonucleotide
cggtacttgagcaatgcctacgcccgggaagaattcgcttccacctgtccagatgatgaggagatcga

SEQ ID NO: 2429 - DNA, 67 bp, Artificial Sequence
  Synthetic Oligonucleotide
accgtatggacagccacagcctggctttgggtacagcatgtgagatgaagcgctgatcctgtagtca

SEQ ID NO: 2430 - DNA, 76 bp, Artificial Sequence
  Synthetic Oligonucleotide
ccccaggatacctaccactacctgcccttcagcctgccccaccggaggcctcacttcttctttcccaagtcccgca

SEQ ID NO: 2431 - DNA, 86 bp, Artificial Sequence
  Synthetic Oligonucleotide
gacatttccagtcctgcagtcaatgcctctctgccccaccctttgttcagtgtggctggtgccacgacaaatgtgtgcgatcggag

SEQ ID NO: 2432 - DNA, 84 bp, Artificial Sequence
  Synthetic Oligonucleotide
tccctccactcggaaggactatcctgctgccaagagggtcaagttggacagtgtcagagtcctgagacagatcagcaacaaccg

SEQ ID NO: 2433 - DNA, 64 bp, Artificial Sequence
  Synthetic Oligonucleotide
tccaccctcctggctttggccagcatggcgaagacgaaaggaaacaaggtgaacgtgggagtga

SEQ ID NO: 2434 - DNA, 68 bp, Artificial Sequence
  Synthetic Oligonucleotide
gtggccatccagctgaccttcctgcgcctgatgtccaccgaggcctcccagaacatcacctaccactg

SEQ ID NO: 2435 - DNA, 80 bp, Artificial Sequence
  Synthetic Oligonucleotide
cagccaagaactggtataggagctccaaggacaagaaacacgtctggctaggagaaactatcaatgctggcagccagttt

SEQ ID NO: 2436 - DNA, 72 bp, Artificial Sequence
  Synthetic Oligonucleotide
atgcccagtgttcctgacttcgaaacgctattctcacaggttcagctcttcatcagcacttgtaatggggag

SEQ ID NO: 2437 - DNA, 79 bp, Artificial Sequence
  Synthetic Oligonucleotide
tctgcagagttggaagcactctatggtgacatcgatgctgtggagctgtatcctgcccttctggtagaaaagcctcggc

SEQ ID NO: 2438 - DNA, 80 bp, Artificial Sequence
  Synthetic Oligonucleotide
tcgagtctcccttcaccatttccgacggcatctacggctcaacattttttgtagccacaggcttccacggacttcacgtc

SEQ ID NO: 2439 - DNA, 73 bp, Artificial Sequence
  Synthetic Oligonucleotide
cgtgagtacacagatgcctccttcacaaatcgaaaggagagaggccctgaagaagagcatcttggcatcctgg

SEQ ID NO: 2440 - DNA, 70 bp, Artificial Sequence
  Synthetic Oligonucleotide
tggtctgcaagcaagtattcaagaaggtgcagtgaggcccaagcagacaaccttgtcccaaccaatcagc

SEQ ID NO: 2441 - DNA, 82 bp, Artificial Sequence
  Synthetic Oligonucleotide
tgggaagcagctgtgtaccattcctcgcgatgctgcctactacagctatcagaataggtatcatttctgtgagaagtgtttc

SEQ ID NO: 2442 - DNA, 76 bp, Artificial Sequence
  Synthetic Oligonucleotide
gtgctacgccaccctgttcggacccaaaggcgtgaacatcgggggcgcgggctcctacatctacgagaagcccctg

SEQ ID NO: 2443 - DNA, 65 bp, Artificial Sequence
  Synthetic Oligonucleotide
gggtctgtgccccatgacacctggctgcccaagaagtgttccctgtgtaaatgctggcacggtca

SEQ ID NO: 2444 - DNA, 75 bp, Artificial Sequence
  Synthetic Oligonucleotide
ctccctaacctccagaatgggcccatatatgccagggttatccagaagcgagtccccaatgcctacgacaagaca

SEQ ID NO: 2445 - DNA, 72 bp, Artificial Sequence
  Synthetic Oligonucleotide
aaggtttttggattgcaaggggtttccaggggcatgtatgacggtcctgtgtacgaggtaccagctacaccc

SEQ ID NO: 2446 - DNA, 69 bp, Artificial Sequence
  Synthetic Oligonucleotide
gatgtgattgaggtgcatggaaaacatgaagagcgccaggatgaacatggtttcatctccagggagttc

SEQ ID NO: 2447 - DNA, 72 bp, Artificial Sequence
  Synthetic Oligonucleotide
ttacgcagctcatgctcttgaacggctctttactatgcgagggcctaacaatgccactctctttacagctgc

SEQ ID NO: 2448 - DNA, 74 bp, Artificial Sequence
  Synthetic Oligonucleotide
tgcagcggctgattgacagtcagatggagacctcgtgccaaattacatttgagtttgtagaccaggaacagttg

SEQ ID NO: 2449 - DNA, 64 bp, Artificial Sequence
  Synthetic Oligonucleotide
cctgaacatgaaggagctgaagctgctgcagaccatcgggaagggggagttcggagacgtgatg

SEQ ID NO: 2450 - DNA, 72 bp, Artificial Sequence
  Synthetic Oligonucleotide
gctctccatcagctcctgtctccagcagctttccctgttgatgtggatcacgcagtgctttctgcccgtgtt

SEQ ID NO: 2451 - DNA, 76 bp, Artificial Sequence
  Synthetic Oligonucleotide
gagttcaagtgccctgacggcgaggtcatgaagaagaacatgatgttcatcaagacctgtgcctgccattacaact

SEQ ID NO: 2452 - DNA, 67 bp, Artificial Sequence
  Synthetic Oligonucleotide
gctcacttcggctaaaatgcagaaatgcatgctgtcagcgttggtatttcacattcaatggagctga

SEQ ID NO: 2453 - DNA, 70 bp, Artificial Sequence
  Synthetic Oligonucleotide
cactgaggtccgggtgacagtgcttcggcaggctgacagccaggtgactgaagtctgtgcggcaacctac

SEQ ID NO: 2454 - DNA, 67 bp, Artificial Sequence
  Synthetic Oligonucleotide
gttttccaggtcggagacggaagaccggaggcagtagctgcaaagcccttggaacaccctggatgct

SEQ ID NO: 2455 - DNA, 62 bp, Artificial Sequence
  Synthetic Oligonucleotide
ggccgagatctacaaaaacggccccgtggagggagctttctctgtgtattcggacttcctgc

SEQ ID NO: 2456 - DNA, 80 bp, Artificial Sequence
  Synthetic Oligonucleotide
gtacatgatcccctgtgagaaggtgtccaccctgcccgcgatcacactgaagctgggaggcaaaggctacaagctgtccc

SEQ ID NO: 2457 - DNA, 77 bp, Artificial Sequence
  Synthetic Oligonucleotide
gcaagttccaacctggaaaggccatcggctttgtcaaggatgtagccaacatcacaatctatgacgaggaagcgatg

SEQ ID NO: 2458 - DNA, 74 bp, Artificial Sequence
  Synthetic Oligonucleotide
gggaggcttatctcactgagtgagcagaatctggtagactgctctgggcctcaaggcaatgaaggctgcaatgg

SEQ ID NO: 2459 - DNA, 67 bp, Artificial Sequence
  Synthetic Oligonucleotide
tgtctcactgagcgagcagaatctggtggactgttcgcgtcctcaaggcaatcagggctgcaatggt

SEQ ID NO: 2460 - DNA, 71 bp, Artificial Sequence
  Synthetic Oligonucleotide
atgccctggtaatgtctgcattcaacaatgacgctggctttgtggctgctcttgataaggcttgtggtcgc

SEQ ID NO: 2461 - DNA, 75 bp, Artificial Sequence
  Synthetic Oligonucleotide
aagcatcttcctgttcttggaccgcacctatgtgctgcagaactccacgctgccctccatctgggatatgggatt

SEQ ID NO: 2462 - DNA, 67 bp, Artificial Sequence
  Synthetic Oligonucleotide
gagctacagatgcccatgccgattcttcgaaagccatgttgccagagccaacgtcaagcatctcaaa

SEQ ID NO: 2463 - DNA, 72 bp, Artificial Sequence
  Synthetic Oligonucleotide
tgaccgcttctaccccaatgacttgtgggtggttgtgttccagtttcagcacatcatggttggccttatcct

SEQ ID NO: 2464 - DNA, 77 bp, Artificial Sequence
  Synthetic Oligonucleotide
ggtgcctactccattgtggcgggcgtgtttgtgtgcctgctggagtacccccgggggaagaggaagaagggctccac

SEQ ID NO: 2465 - DNA, 71 bp, Artificial Sequence
  Synthetic Oligonucleotide
ccagctttgtgcctgtcactattcctcatgccaccactgccaacacctctgtcttgggctaccacattccc

SEQ ID NO: 2466 - DNA, 73 bp, Artificial Sequence
  Synthetic Oligonucleotide
ccgtgttcaagaggaagctcactgccttgtggaggagttgagaaaaaccaaggcttcaccctgtgatcccact

SEQ ID NO: 2467 - DNA, 79 bp, Artificial Sequence
  Synthetic Oligonucleotide
agaacaaggacaacatagatccttacatatacacaccctttggaagtggacccagaaactgcattggcatgaggtttgc

SEQ ID NO: 2468 - DNA, 76 bp, Artificial Sequence
  Synthetic Oligonucleotide
tgctcattcttgaggagcattaaggtatttcgaaactgccaagggtgctggtgcggatggacactaatgcagccac

SEQ ID NO: 2469 - DNA, 77 bp, Artificial Sequence
  Synthetic Oligonucleotide
cgctgacatcatgaatgttcctcgaccggctggaggcgagtttggatatgacaaagacacatcgttgctgaaagaga

SEQ ID NO: 2470 - DNA, 75 bp, Artificial Sequence
  Synthetic Oligonucleotide
aaatgtcctcctcgactgctccgcggagtccgaccgaggagttccagtgatcaagtggaagaaagatggcattca

SEQ ID NO: 2471 - DNA, 66 bp, Artificial Sequence
  Synthetic Oligonucleotide
ggtcaccgttggtgtcatcacagtgctggtagtggtcatcgtggctgtgatttgcacccgacgctc

SEQ ID NO: 2472 - DNA, 74 bp, Artificial Sequence
  Synthetic Oligonucleotide
atggagatgtggtcattcctagtgattattttcagatagtgggaggaagcaacttacggatacttggggtggtg

SEQ ID NO: 2473 - DNA, 110 bp, Artificial Sequence
  Synthetic Oligonucleotide
gccgccacaagactaaggaatggccaccccgcccaagagaagctgcccgtctttctcagccagctctgaggggacccgcatcaagaaaatctccatcgaagggaacatcg

SEQ ID NO: 2474 - DNA, 68 bp, Artificial Sequence
  Synthetic Oligonucleotide
tgcggatcatccggaatggaattggaatccacgagcatgccagcattgacttaccaggcatcaaagga

SEQ ID NO: 2475 - DNA, 70 bp, Artificial Sequence
  Synthetic Oligonucleotide
cttgtggagatcacccaatcaggttctatgcccgggactcgggcctgctcaagtttgagatccaggcggg

SEQ ID NO: 2476 - DNA, 73 bp, Artificial Sequence
  Synthetic Oligonucleotide
ttgctataactaagtgcttctccaagaccccaactgagtccccagcacctgctacagtgagctgccattccac

SEQ ID NO: 2477 - DNA, 78 bp, Artificial Sequence
  Synthetic Oligonucleotide
gggagaacgggatcaataggatcggaaacctgctggtgcccaatgagaattactgcaagtttgaggactggctgatgc

SEQ ID NO: 2478 - DNA, 73 bp, Artificial Sequence
  Synthetic Oligonucleotide
cacaatggcggctctgaagagttggctgtcgcgcagcgtaacttcattcttcaggtacagacagtgtttgtgt

SEQ ID NO: 2479 - DNA, 62 bp, Artificial Sequence
  Synthetic Oligonucleotide
caagcagtcaaggagaaccagaagcggcgggagacagaagaaaagatgaggcgagcaaaact

SEQ ID NO: 2480 - DNA, 68 bp, Artificial Sequence
  Synthetic Oligonucleotide
tccaattccagcatcactgtggagaaaagctgtttgtctccccagcatactttatcgccttcactgcc

SEQ ID NO: 2481 - DNA, 70 bp, Artificial Sequence
  Synthetic Oligonucleotide
tgacaactaccagccgtacccgtgcgcagaggacgaggagtgcggcactgatgagtactgcgctagtccc

SEQ ID NO: 2482 - DNA, 68 bp, Artificial Sequence
  Synthetic Oligonucleotide
gattcagacgaggatgagccttgtgccatcagtggcaaatggactttccaaagggacagcaagaggtg

SEQ ID NO: 2483 - DNA, 87 bp, Artificial Sequence
  Synthetic Oligonucleotide
aggacgcaaggagggtttgtcactggcagactcgagactgtaggcactgccatggcccctgtgctcagtaaggactcggcggacatc

SEQ ID NO: 2484 - DNA, 83 bp, Artificial Sequence
  Synthetic Oligonucleotide
tgcacagagggtgtgggttacaccaatgcttccaacaatttgtttgcttgcctcccatgtacagcttgtaaatcagatgaaga

SEQ ID NO: 2485 - DNA, 84 bp, Artificial Sequence
  Synthetic Oligonucleotide
ctctgagacagtgcttcgatgactttgcagacttggtgccctttgactcctgggagccgctcatgaggaagttgggcctcatgg

SEQ ID NO: 2486 - DNA, 67 bp, Artificial Sequence
  Synthetic Oligonucleotide
cctggatctcccaggtatcattgaaggtgccaaggatgggaaaggtagaggtcgtcaagtcattgca

SEQ ID NO: 2487 - DNA, 73 bp, Artificial Sequence
  Synthetic Oligonucleotide
tggcactactgcatgattgacatagagaagatcagggccatgacaatcgccaagctgaaaacaatgcggcagg

SEQ ID NO: 2488 - DNA, 78 bp, Artificial Sequence
  Synthetic Oligonucleotide
aaatcgctgggaacaagtgccgttaattaaggaaaagttgagccagggcgtgaccctcgtcgtggacagatacgcatt

SEQ ID NO: 2489 - DNA, 76 bp, Artificial Sequence
  Synthetic Oligonucleotide
agacatcagctcctggttcaacgaggccattgacttcatagactccatcaagaatgctggaggaagggtgtttgtc

SEQ ID NO: 2490 - DNA, 76 bp, Artificial Sequence
  Synthetic Oligonucleotide
tatccctgtggaggacaaccagatggtggagatcagtgcctggttccaggaggccataggcttcattgactgggtg

SEQ ID NO: 2491 - DNA, 67 bp, Artificial Sequence
  Synthetic Oligonucleotide
acacatggagtgcttctggaactatcagcccacttgaccacccagtttgtggaagcacaggcaagag

SEQ ID NO: 2492 - DNA, 79 bp, Artificial Sequence
  Synthetic Oligonucleotide
agcatgacacggagatgaagtactatatagtacacctgaagcggcacttcatgttccggaaccacctgtgcctggtatt

SEQ ID NO: 2493 - DNA, 75 bp, Artificial Sequence
  Synthetic Oligonucleotide
actccctctacccttgagcaagggcaggggtccctgagctgttcttctgccccatactgaaggaactgaggcctg

SEQ ID NO: 2494 - DNA, 73 bp, Artificial Sequence
  Synthetic Oligonucleotide
tgccacctggacatcatttgggtcaacactcccgagcacgttgttccgtatggacttggaagccctaggtcca

SEQ ID NO: 2495 - DNA, 68 bp, Artificial Sequence
  Synthetic Oligonucleotide
tacatctccaaacccatccaccagcatgaagaccgctgcttgaggttgaaggtgactgtcagtggcaa

SEQ ID NO: 2496 - DNA, 67 bp, Artificial Sequence
  Synthetic Oligonucleotide
actacatctccacgcccactcacaacctgcactggaagtgtctgaggatgaaggtgttcgtctgctg

SEQ ID NO: 2497 - DNA, 66 bp, Artificial Sequence
  Synthetic Oligonucleotide
ggagcccgtatcctggagctccctcaaccccaagttcctgagtgggaagggcttggtgatctatcc

SEQ ID NO: 2498 - DNA, 73 bp, Artificial Sequence
  Synthetic Oligonucleotide
tgacattatcatcccgctaaggactgcggacagcgtcttctgccctcactacgagaaggtcagcggggactac

SEQ ID NO: 2499 - DNA, 74 bp, Artificial Sequence
  Synthetic Oligonucleotide
ttgaacagagcctgaccaagagggatgagttcgagtttctggagaaagcatcaaaactgcgaggaatctcaaca

SEQ ID NO: 2500 - DNA, 62 bp, Artificial Sequence
  Synthetic Oligonucleotide
tgtcgatggacttccagaaccacctgggcagctgccaaaagtgtgatccaagctgtcccaat

SEQ ID NO: 2501 - DNA, 79 bp, Artificial Sequence
  Synthetic Oligonucleotide
tcaatggccggacgaaagccatggttgcttgttatccgggcaatggaacgggttatgtacgtcatgttgataatccaaa

SEQ ID NO: 2502 - DNA, 68 bp, Artificial Sequence
  Synthetic Oligonucleotide
gctggtcctctactgcgggagccggctgggcaaatactacgtcaaggagaggtctaaggcaatggtgg

SEQ ID NO: 2503 - DNA, 76 bp, Artificial Sequence
  Synthetic Oligonucleotide
gtccccgctgcagatctctgacccgttcggatcctttcctcactcgcccaccatggacaactaccctaagctggag

SEQ ID NO: 2504 - DNA, 78 bp, Artificial Sequence
  Synthetic Oligonucleotide
ccatgtggatgaatgaggtgtctcctttccatacccagtctcaccttctccccaccctacctcacctcttctcaggca

SEQ ID NO: 2505 - DNA, 72 bp, Artificial Sequence
  Synthetic Oligonucleotide
aaagtggtgaatgccatttggtttcaggatatagctgacctggcatttgaggtatcagggaggaagcctcac

SEQ ID NO: 2506 - DNA, 82 bp, Artificial Sequence
  Synthetic Oligonucleotide
gatctaagatggcgactgtcgaaccggaaaccacccctactcctaatcccccgactacagaagaggagaaaacggaatctaa

SEQ ID NO: 2507 - DNA, 67 bp, Artificial Sequence
  Synthetic Oligonucleotide
aagccgcggttgaatgtgccatgaccctctccctctctggatggcaccatcattgaagctggcgtca

SEQ ID NO: 2508 - DNA, 77 bp, Artificial Sequence
  Synthetic Oligonucleotide
gacaggaggcctctatcctgtccctccaccccaccctccacctcaatcccctcccatcttccccagacctacctcac

SEQ ID NO: 2509 - DNA, 75 bp, Artificial Sequence
  Synthetic Oligonucleotide
gctagtactttgatgctcccttgatggggtccagagagcctccctgcagccaccagacttggcctccagctgttc

SEQ ID NO: 2510 - DNA, 69 bp, Artificial Sequence
  Synthetic Oligonucleotide
tggcctacctcttcaccatcatcaacagcctccaaggcttcttcatcttcttggtctactgcctcctca

SEQ ID NO: 2511 - DNA, 68 bp, Artificial Sequence
  Synthetic Oligonucleotide
ggcagtgtcactgagtccttgaaatcctcccctgccccgcgggtctctggattgggacgcacagtgca

SEQ ID NO: 2512 - DNA, 68 bp, Artificial Sequence
  Synthetic Oligonucleotide
caaggccgtgaacgagaagtcctgcaactgcctcctgctcaaagtcaaccagattggctccgtgaccg

SEQ ID NO: 2513 - DNA, 75 bp, Artificial Sequence
  Synthetic Oligonucleotide
agccccagcaactacagtctgggatgccaaggccagccatgatgtcagtggcccagcatggtcaacctttgaaca

SEQ ID NO: 2514 - DNA, 72 bp, Artificial Sequence
  Synthetic Oligonucleotide
aagccttggagggtttcattgccgtggtgacccaagatggcgacatgatctttctgtcagaaaacatcagca

SEQ ID NO: 2515 - DNA, 75 bp, Artificial Sequence
  Synthetic Oligonucleotide
gggccctccagaacaatgatgggctttatgatcctgactgcgatgagagcgggctctttaaggccaagcagtgca

SEQ ID NO: 2516 - DNA, 72 bp, Artificial Sequence
  Synthetic Oligonucleotide
cgcctgttcaccaagattgacaccattgcgcccgatgagatcaccgtcagcagcgacttcgaggcacgccac

SEQ ID NO: 2517 - DNA, 66 bp, Artificial Sequence
  Synthetic Oligonucleotide
caaccaggcagctccatcggcagtgtccatcatgcatcaggtgagccgcaccgtggacagcattac

SEQ ID NO: 2518 - DNA, 77 bp, Artificial Sequence
  Synthetic Oligonucleotide
tgaacggggtatcctccttagccacggggcccgtcccatttgagcctgtcaatgtcaccactgaccgagaggtacct

SEQ ID NO: 2519 - DNA, 69 bp, Artificial Sequence
  Synthetic Oligonucleotide
actggtcctccatcggctccccaggagctttggtttgaggtgcaaggctcagcactcatgctacactgg

SEQ ID NO: 2520 - DNA, 67 bp, Artificial Sequence
  Synthetic Oligonucleotide
actgtggcacttaggggagatgacatttgctttgggcagaggcagctagccaggacacatttccact

SEQ ID NO: 2521 - DNA, 81 bp, Artificial Sequence
  Synthetic Oligonucleotide
cggttatgtcatgccagatacacacctcaaaggtactccctcctcccgggaaggcaccctttcttcagtgggtctcagttc

SEQ ID NO: 2522 - DNA, 67 bp, Artificial Sequence
  Synthetic Oligonucleotide
gtccaggtggatgtgaaagatccccagcaggccctcaaggagctggctaagatgtgtatcctggccg

SEQ ID NO: 2523 - DNA, 69 bp, Artificial Sequence
  Synthetic Oligonucleotide
tggccttcttcaccagctaccagtacatggagagcaccgtggcctcctggtatgagcaggggatccttg

SEQ ID NO: 2524 - DNA, 91 bp, Artificial Sequence
  Synthetic Oligonucleotide
ataacaaagtgtagctctgacatgaatggctattgtttgcatggacagtgcatctatctggtggacatgagtcaaaactactgcaggtgtg

SEQ ID NO: 2525 - DNA, 67 bp, Artificial Sequence
  Synthetic Oligonucleotide
acggatcacagtggaggaagcgctggctcacccctacctggagcagtactatgacccgacggatgag

SEQ ID NO: 2526 - DNA, 68 bp, Artificial Sequence
  Synthetic Oligonucleotide
agttcttgacccctggtcctgtctccagcccgtcttggcttatccactttgactcctttgagccgttt

SEQ ID NO: 2527 - DNA, 70 bp, Artificial Sequence
  Synthetic Oligonucleotide
acccccagaccggatcaggcaagctggccctcatgtccccttcacggtgtttgaggaagtctgccctaca

SEQ ID NO: 2528 - DNA, 68 bp, Artificial Sequence
  Synthetic Oligonucleotide
cgtggtgcccctctatgacctgctgctggagatgctggacgcccaccgcctacatgcgcccactagcc

SEQ ID NO: 2529 - DNA, 67 bp, Artificial Sequence
  Synthetic Oligonucleotide
tccagtgcctatgacccccccagacaaatcgccatcaagtcccctgcccctggtgcccttggacagt

SEQ ID NO: 2530 - DNA, 73 bp, Artificial Sequence
  Synthetic Oligonucleotide
gtgaaggatgtgaagcagacgtacttggcacgggtcttctcctacccggcagggaatgtggagagcaccggtt

SEQ ID NO: 2531 - DNA, 66 bp, Artificial Sequence
  Synthetic Oligonucleotide
gctttgccaccaggaaagtggctggcatggccaaacctaacatgatcatcagtgtgaatggggatg

SEQ ID NO: 2532 - DNA, 66 bp, Artificial Sequence
  Synthetic Oligonucleotide
ctgaccagaaccacggcttatccggcctgtccacgaaccacttatacacccacatgacccacttcc

SEQ ID NO: 2533 - DNA, 91 bp, Artificial Sequence
  Synthetic Oligonucleotide
ggattgctcaacaaccatgctgggcatctggaccctcctacctctggttcttacgtctgttgctagattatcgtccaaaagtgttaatgcc

SEQ ID NO: 2534 - DNA, 80 bp, Artificial Sequence
  Synthetic Oligonucleotide
gcactttgggattctttccattatgattctttgttacaggcaccgagaatgttgtattcagtgagggtcttcttacatgc

SEQ ID NO: 2535 - DNA, 66 bp, Artificial Sequence
  Synthetic Oligonucleotide
gcctcttcctgttcgacggctcgcccacctacgtactggcctacacccagagctaccgggcaaagc

SEQ ID NO: 2536 - DNA, 90 bp, Artificial Sequence
  Synthetic Oligonucleotide
ggctattcctcattttctctacaaagtggcctcagtgaacatgaagaaggtagcctcctggaggagaatttcggtgacagtctacaatcc

SEQ ID NO: 2537 - DNA, 73 bp, Artificial Sequence
  Synthetic Oligonucleotide
ccccagtttcaacgagacttcatttcattgctccctaaagagttggcactctatgtgctttcattcctggaac

SEQ ID NO: 2538 - DNA, 71 bp, Artificial Sequence
  Synthetic Oligonucleotide
gagatgattcagttaccgggagcccggcccattttggatcctgtggatttcttgggtctccaggacaagat

SEQ ID NO: 2539 - DNA, 68 bp, Artificial Sequence
  Synthetic Oligonucleotide
ctctgcaggcctaggtgcagctcctcagcggctccagctcatatgctgacagctcttcacagtcctgg

SEQ ID NO: 2540 - DNA, 68 bp, Artificial Sequence
  Synthetic Oligonucleotide
cggtagtcaagtccggatcaagggcaaggagacggaattctacctgtgcatgaaccgcaaaggcaagc

SEQ ID NO: 2541 - DNA, 76 bp, Artificial Sequence
  Synthetic Oligonucleotide
agatgcaggagagaggaagccttgcaaacctgcagactgctttttgcccaatatagattgggtaaggctgcaaaac

SEQ ID NO: 2542 - DNA, 74 bp, Artificial Sequence
  Synthetic Oligonucleotide
cacgggacattcaccacatcgactactataaaaagacaaccaacggccgactgcctgtgaagtggatggcaccc

SEQ ID NO: 2543 - DNA, 80 bp, Artificial Sequence
  Synthetic Oligonucleotide
gagggactgttggcatgcagtgccctcccagagaccaacgttcaagcagttggtagaagacttggatcgaattctcactc

SEQ ID NO: 2544 - DNA, 67 bp, Artificial Sequence
  Synthetic Oligonucleotide
ccagtggagcgcttccatgacctgcgtcctgatgaagtggccgatttgtttcagacgacccagagag

SEQ ID NO: 2545 - DNA, 72 bp, Artificial Sequence
  Synthetic Oligonucleotide
ggttccagctttctgtagctgtaagcattggtggccacaccacctccttacaaagcaactagaacctgcggc

SEQ ID NO: 2546 - DNA, 66 bp, Artificial Sequence
  Synthetic Oligonucleotide
ccaccagcatgaagtttcggacagacatggcctttgtgaggggttccagttgtgcttcagacagcc

SEQ ID NO: 2547 - DNA, 73 bp, Artificial Sequence
  Synthetic Oligonucleotide
gccacacaaacatgctcctgctcctggcggaggcagagctgctgggaaagacatttcggaagtttcctgtggc

SEQ ID NO: 2548 - DNA, 75 bp, Artificial Sequence
  Synthetic Oligonucleotide
ggctcccgaatctatctttgacaaaatctacagcaccaagagcgacgtgtggtcttacggagtattgctgtggga

SEQ ID NO: 2549 - DNA, 69 bp, Artificial Sequence
  Synthetic Oligonucleotide
accaagaagctgaggacctgtggctgagcccgctgaccatggaagatcttgtctgctacagcttccagg

SEQ ID NO: 2550 - DNA, 67 bp, Artificial Sequence
  Synthetic Oligonucleotide
cgagccctttgatgacttcctgttcccagcatcatccaggcccagtggctctgagacagcccgctcc

SEQ ID NO: 2551 - DNA, 83 bp, Artificial Sequence
  Synthetic Oligonucleotide
tgaagtccaggacgatgatgcgcctctctcgcccatgctctacagcagctcagccagcctgtcaccttcagtaagcaagccgt

SEQ ID NO: 2552 - DNA, 66 bp, Artificial Sequence
  Synthetic Oligonucleotide
cagccctgccagtttgactatgccgtcttctgccctaacctgacagaggtgtcatccacaggcaac

SEQ ID NO: 2553 - DNA, 75 bp, Artificial Sequence
  Synthetic Oligonucleotide
ttggtacctgtgggttagcatcaagttctccccagggtagaattcaatcagagctccagtttgcatttggatgtg

SEQ ID NO: 2554 - DNA, 72 bp, Artificial Sequence
  Synthetic Oligonucleotide
gtaagtcggatgagcctgtctgtgccagtgacaatgccacttatgccagcgagtgtgccatgaaggaagctg

SEQ ID NO: 2555 - DNA, 95 bp, Artificial Sequence
  Synthetic Oligonucleotide
aagtcctcgatacgcactatagcaccgagaatgacgtggagaccatccgggccagcgtctgcgccccctgccacgcctcatgtgccacatgccag

SEQ ID NO: 2556 - DNA, 80 bp, Artificial Sequence
  Synthetic Oligonucleotide
ggataattcagacaacaacaccatctttgtgcaaggcctgggtgagaatgttacaattgagtctgtggctgattacttca

SEQ ID NO: 2557 - DNA, 66 bp, Artificial Sequence
  Synthetic Oligonucleotide
ccgtgctcattgctaaccactgtctgtccctgaactcccagaaccactacatctggctttgggcag

SEQ ID NO: 2558 - DNA, 73 bp, Artificial Sequence
  Synthetic Oligonucleotide
cagttcggtccaacagagaaagcaggcaaccaccatgtcatttgaaaacagtttcatcgggatataattcgca

SEQ ID NO: 2559 - DNA, 66 bp, Artificial Sequence
  Synthetic Oligonucleotide
cgtgtgtctcaagacgatcccactgtgtaccctaatgggtcccgcttcccagacagcacagggacc

SEQ ID NO: 2560 - DNA, 67 bp, Artificial Sequence
  Synthetic Oligonucleotide
agagcaccaaagcagctcatcccactgatgacaccacgacgctctctgagagaccatccccaagcac

SEQ ID NO: 2561 - DNA, 69 bp, Artificial Sequence
  Synthetic Oligonucleotide
gaagcgcagatcatgaagaagctgaagcacgacaagctggtccagctctatgcagtggtgtctgaggag

SEQ ID NO: 2562 - DNA, 75 bp, Artificial Sequence
  Synthetic Oligonucleotide
ggtgcaccagttctaccctctagtgaaagtgcagtgttccgctgagctcaagttcttcctgtgctccatgtacgc

SEQ ID NO: 2563 - DNA, 78 bp, Artificial Sequence
  Synthetic Oligonucleotide
tggatcctcacctggtcggtgctgtgctgcgcttccaccttcttcactgtcaccacgtacttggtagacatgcagcgc

SEQ ID NO: 2564 - DNA, 67 bp, Artificial Sequence
  Synthetic Oligonucleotide
aatgagagaggtgaaagcggacggagctagcacccccaggttaagagaacaggactgtggtgaacct

SEQ ID NO: 2565 - DNA, 68 bp, Artificial Sequence
  Synthetic Oligonucleotide
tcagcagcaagggcatcatggaggaggatgaggcctgcgggcgccagtacacgctcaagaaaaccacc

SEQ ID NO: 2566 - DNA, 61 bp, Artificial Sequence
  Synthetic Oligonucleotide
caacgaattccaggtgtccctgagcagctccatgtcggtgtcagagctgaaggcgcagatc

SEQ ID NO: 2567 - DNA, 73 bp, Artificial Sequence
  Synthetic Oligonucleotide
gtgctggtgacgaatccacattcatctcaatggaaggatcctgccttaagtcaacttatttgtttttgccggg

SEQ ID NO: 2568 - DNA, 70 bp, Artificial Sequence
  Synthetic Oligonucleotide
accctcgacaagaccacactttgggacttgggagctggggctgaagttgctctgtacccatgaactccca

SEQ ID NO: 2569 - DNA, 66 bp, Artificial Sequence
  Synthetic Oligonucleotide
cgcgctgcagatccattttacgctgatccaggctttctgctgcgagaacgacatcgacatagtgcg

SEQ ID NO: 2570 - DNA, 74 bp, Artificial Sequence
  Synthetic Oligonucleotide
ggaacagggtcacccacagactgggtgtgagtgtgaagatggtcctgatgggcaggagatggacccgccaaatc

SEQ ID NO: 2571 - DNA, 73 bp, Artificial Sequence
  Synthetic Oligonucleotide
ttgggaaatatttgggcattggtctggccaagtctacaatgtcccaatatcaaggacaaccaccctagcttct

SEQ ID NO: 2572 - DNA, 83 bp, Artificial Sequence
  Synthetic Oligonucleotide
gcatgggaaccatcaaccagcaggccatggaccaacttcactatgtgacagagctgacagatcgaatcaaggcaaactcctca

SEQ ID NO: 2573 - DNA, 71 bp, Artificial Sequence
  Synthetic Oligonucleotide
ctgttgcaggaaggcattgatcatctcctggcccagcatgttgctcatctctttattagagacccactgac

SEQ ID NO: 2574 - DNA, 85 bp, Artificial Sequence
  Synthetic Oligonucleotide
tgtagaatcaaactcttcatcatcaactagaagtgcagttgacatggcctgttcagtccttggagttgcacagctggattctgtg

SEQ ID NO: 2575 - DNA, 75 bp, Artificial Sequence
  Synthetic Oligonucleotide
tggtgcttggagcatagaagactgcccttcacaaaggaaatccctgattattgtttgaaatgctgaggacgttgc

SEQ ID NO: 2576 - DNA, 72 bp, Artificial Sequence
  Synthetic Oligonucleotide
cgctccagacctatgatgacttgttagccaaagactgccactgcatatgagcagtcctggtccttccactgt

SEQ ID NO: 2577 - DNA, 71 bp, Artificial Sequence
  Synthetic Oligonucleotide
gtgtatgacgaggtggatcgaagagaaaatgatgcagtgtggctggctacccaaaaccacagcactctggt

SEQ ID NO: 2578 - DNA, 68 bp, Artificial Sequence
  Synthetic Oligonucleotide
gttcactgggggtgtatggggtagatgggtggagagggaggggataagagaggtgcatgttggtattt

SEQ ID NO: 2579 - DNA, 74 bp, Artificial Sequence
  Synthetic Oligonucleotide
tgtcatgtacgacggcttctccatgcagcggctggtgaagtgcaacgcctggccttgtcccaacactgtggact

SEQ ID NO: 2580 - DNA, 67 bp, Artificial Sequence
  Synthetic Oligonucleotide
gcttatgaccgaccccaagctcatcacctggtctccggtgtgtcgcaacgatgttgcctggaacttt

SEQ ID NO: 2581 - DNA, 75 bp, Artificial Sequence
  Synthetic Oligonucleotide
cacacagatctcctactccatccagtcctgaggagccttaggatgcagcatgccttcaggagacactgctggacc

SEQ ID NO: 2582 - DNA, 67 bp, Artificial Sequence
  Synthetic Oligonucleotide
cttcgcctttgctgattgcctctccaaacgcctgcctgacgactgccttggagcatgtgcgttatgg

SEQ ID NO: 2583 - DNA, 76 bp, Artificial Sequence
  Synthetic Oligonucleotide
tcccactgaagccctttcagttgcggttgaagaaggactcgcttggaggaaaaaaggatgtttacgcctgggcact

SEQ ID NO: 2584 - DNA, 79 bp, Artificial Sequence
  Synthetic Oligonucleotide
gtccatcagtgcatgacgtttaaggccacgtatagtcctagctgacgccaataataaaaaacaagaaaccaagtgggct

SEQ ID NO: 2585 - DNA, 67 bp, Artificial Sequence
  Synthetic Oligonucleotide
ccatctgcatccatcttgtttgggctccccacccttgagaagtgcctcagataataccctggtggcc

SEQ ID NO: 2586 - DNA, 75 bp, Artificial Sequence
  Synthetic Oligonucleotide
gttgggtgcatctctcgggcgtccggcagcggctgtatctcggcatgaattaagaagctaggaagatggagcacg

SEQ ID NO: 2587 - DNA, 73 bp, Artificial Sequence
  Synthetic Oligonucleotide
cgaaaagatgctgaacagtgacaaatccaactgaccagaagggaggaggaagctcactggtggctgttcctga

SEQ ID NO: 2588 - DNA, 81 bp, Artificial Sequence
  Synthetic Oligonucleotide
ctgggtctcatagaagcaaaggagaacagaaaccaccagccacctcaacccaaggccttgggcaatcagcagccttcgtgg

SEQ ID NO: 2589 - DNA, 73 bp, Artificial Sequence
  Synthetic Oligonucleotide
atgctgctggccattccagaggccgtgttttctgacctccatcccttccatgaggaaagcaccaaccagacct

SEQ ID NO: 2590 - DNA, 66 bp, Artificial Sequence
  Synthetic Oligonucleotide
gacaaggacggcagcaaggtgacaacagtggtggcaactcctgggcagggtccagacaggccacaa

SEQ ID NO: 2591 - DNA, 66 bp, Artificial Sequence
  Synthetic Oligonucleotide
tctccaacttccctctgctgaaggccctgaaaaccagaatcagcaacctgcccacggtgaagaagt

SEQ ID NO: 2592 - DNA, 86 bp, Artificial Sequence
  Synthetic Oligonucleotide
aagctatgaggaaaagaagtacacgatgggggacgctcctgattatgacagaagccagtggctgaatgaaaaattcaagctgggcc

SEQ ID NO: 2593 - DNA, 76 bp, Artificial Sequence
  Synthetic Oligonucleotide
caatgccatcttgcgctacatcgctcgcaagcacaacatgtgtggtgagactgaagaagaaaagattcgagtggac

SEQ ID NO: 2594 - DNA, 76 bp, Artificial Sequence
  Synthetic Oligonucleotide
gagaccctgctgtcccagaaccagggaggcaagaccttcattgtgggagaccagatctccttcgctgactacaacc

SEQ ID NO: 2595 - DNA, 66 bp, Artificial Sequence
  Synthetic Oligonucleotide
caccatccccaccctgtcttccacagccgcctgaaagccacaatgagaatgatgcacactgaggcc

SEQ ID NO: 2596 - DNA, 71 bp, Artificial Sequence
  Synthetic Oligonucleotide
ccggaaaggccaagacaaaggcggtttcccgctcgcagagagccggcttgcagttcccagtgggccgtatt

SEQ ID NO: 2597 - DNA, 80 bp, Artificial Sequence
  Synthetic Oligonucleotide
gactccttcgtccccagttgccgtctaggattgggcctcccataattgctttgccaaaataccagagccttcaagtgcca

SEQ ID NO: 2598 - DNA, 90 bp, Artificial Sequence
  Synthetic Oligonucleotide
tgacacccttaccttcctgagaaataccccctgggagcgcggaaagcagagcggacaggtcagtgacttctatttttgactcgtgttttt

SEQ ID NO: 2599 - DNA, 74 bp, Artificial Sequence
  Synthetic Oligonucleotide
caagtaccacagcgatgactacattaaattcttgcgctccatccgtccagataacatgtcggagtacagcaagc

SEQ ID NO: 2600 - DNA, 76 bp, Artificial Sequence
  Synthetic Oligonucleotide
ggtggctacacaatccgtaatgttgctcgatgttggacatatgagactgcagttgcccttgattgtgagattccca

SEQ ID NO: 2601 - DNA, 66 bp, Artificial Sequence
  Synthetic Oligonucleotide
tcctaggcattctggacctctgggttgggatcaggggtaggaatggaaggatggagcatcaacagc

SEQ ID NO: 2602 - DNA, 60 bp, Artificial Sequence
  Synthetic Oligonucleotide
agccgtgactgttgaggtcaagtccagcatcgcaggcagcagcacctgggaacgttactt

SEQ ID NO: 2603 - DNA, 84 bp, Artificial Sequence
  Synthetic Oligonucleotide
aggctgctggaggtcatctccgtgtgtgattgccccagaggccgtttcttggccgccatctgccaagactgtggccgcaggaag

SEQ ID NO: 2604 - DNA, 70 bp, Artificial Sequence
  Synthetic Oligonucleotide
cggtgtgagaagtgcagcaagccctgtgcccgagtgtgctatggtctgggcatggagcacttgcgagagg

SEQ ID NO: 2605 - DNA, 69 bp, Artificial Sequence
  Synthetic Oligonucleotide
caccctgtcctatccttcctcagaccctcttgggacctagtctctgccttctactctctacccctggcc

SEQ ID NO: 2606 - DNA, 67 bp, Artificial Sequence
  Synthetic Oligonucleotide
ttagggaccctgcagctctggagtgggtggagggagggagctacgggcaggaggaagaattttgtag

SEQ ID NO: 2607 - DNA, 65 bp, Artificial Sequence
  Synthetic Oligonucleotide
ccgaaatccagatgatgatgctcatggaccctggtgctacacgggaaatccactcattccttggg

SEQ ID NO: 2608 - DNA, 82 bp, Artificial Sequence
  Synthetic Oligonucleotide
tgaacataaagtctgcaacatggaaggtattgcactgcacaggccacattcacgtatatgataccaacagtaaccaacctca

SEQ ID NO: 2609 - DNA, 66 bp, Artificial Sequence
  Synthetic Oligonucleotide
tacgcacagaggcaagcagctaagagtccgggatccccagcctactgcctctccagcacttctctc

SEQ ID NO: 2610 - DNA, 73 bp, Artificial Sequence
  Synthetic Oligonucleotide
tccatgatggttctgcaggtttctgcggccccccggacagtggctctgacggcgttactgatggtgctgctca

SEQ ID NO: 2611 - DNA, 67 bp, Artificial Sequence
  Synthetic Oligonucleotide
gacgatttgccagctttgaggctcaaggtgcattggccaacatagctgtggacaaagccaacctgga

SEQ ID NO: 2612 - DNA, 66 bp, Artificial Sequence
  Synthetic Oligonucleotide
gctttctcaggacctggttgctactggttcggcaactgcagaaaatgtcctcccttgtggcttcct

SEQ ID NO: 2613 - DNA, 70 bp, Artificial Sequence
  Synthetic Oligonucleotide
cctgcgcggctactacaaccagagcgaggccagttctcacaccctccagtggatgattggctgcgacctg

SEQ ID NO: 2614 - DNA, 71 bp, Artificial Sequence
  Synthetic Oligonucleotide
tggcctgtccattggtgatgttgcgaagaaactgggagagatgtggaataacactgctgcagatgacaagc

SEQ ID NO: 2615 - DNA, 74 bp, Artificial Sequence
  Synthetic Oligonucleotide
ctacttccagcaaccccagaaagagacatcgggaagattctgatgtggaaatggtggaagatgattcccgaaag

SEQ ID NO: 2616 - DNA, 84 bp, Artificial Sequence
  Synthetic Oligonucleotide
caagggagcgaccaactgatcgcacacatgctttgtttggatatggagtgaacacaattatgtaccaaatttaacttggcaaac

SEQ ID NO: 2617 - DNA, 66 bp, Artificial Sequence
  Synthetic Oligonucleotide
gccagtaagaacgaggaggatgaaggccattcaaactcctccccacgacactctgaagcagcgacg

SEQ ID NO: 2618 - DNA, 69 bp, Artificial Sequence
  Synthetic Oligonucleotide
agtgacagatggacaatgcaagaatgaactccttcctggaataccccatacttagcagtggcgactcgg

SEQ ID NO: 2619 - DNA, 78 bp, Artificial Sequence
  Synthetic Oligonucleotide
tcccttgtgttccttctgtgaagaagccctgttctcgttgccctaattcatcttttaatcatgagcctgtttattgcc

SEQ ID NO: 2620 - DNA, 71 bp, Artificial Sequence
  Synthetic Oligonucleotide
cgtgccttatggttactttggaggcgggtactactcctgccgagtgtcccggagctcgctgaaaccctgtg

SEQ ID NO: 2621 - DNA, 68 bp, Artificial Sequence
  Synthetic Oligonucleotide
cagcctcaagttcggttttcgctaccggagccttcccagaacaaacttcttgtgcgtttgcttccaac

SEQ ID NO: 2622 - DNA, 67 bp, Artificial Sequence
  Synthetic Oligonucleotide
ggacgaatacgaccccactatagaggattcctaccggaagcaggtggtcattgatggggagacgtgc

SEQ ID NO: 2623 - DNA, 67 bp, Artificial Sequence
  Synthetic Oligonucleotide
ggagatggccgagactgaccccaagaccgtgcaggacctcacctcggtggtgcagacactcctgcag

SEQ ID NO: 2624 - DNA, 78 bp, Artificial Sequence
  Synthetic Oligonucleotide
ctggaccgcacggacatccacaccttccaccgcttctaccaatacctcgcccacagcaagcaagtctttcgcgaggcg

SEQ ID NO: 2625 - DNA, 68 bp, Artificial Sequence
  Synthetic Oligonucleotide
gctttccaagtggggaattaaagttgcttccatccaacctggaggcttcctaacaaatatcgcaggca

SEQ ID NO: 2626 - DNA, 70 bp, Artificial Sequence
  Synthetic Oligonucleotide
ctgctgcgacagtccactacctttttcgagagtgactcccgttgtcccaaggcttcccagagcgaacctg

SEQ ID NO: 2627 - DNA, 63 bp, Artificial Sequence
  Synthetic Oligonucleotide
ggtccgcttcgtctttcgagagtgactcccgcggtcccaaggctttccagagcgaacctgtgc

SEQ ID NO: 2628 - DNA, 72 bp, Artificial Sequence
  Synthetic Oligonucleotide
ttcagtgtgtccagtgcatctttagtggaggttcacaagtctgaggaaaatgaggagccaatggaaacagat

SEQ ID NO: 2629 - DNA, 84 bp, Artificial Sequence
  Synthetic Oligonucleotide
ggctagtagaactggatcccaacaccaaactcttaattagacctaggcctcagctgcactgcccgaaaagcatttgggcagacc

SEQ ID NO: 2630 - DNA, 73 bp, Artificial Sequence
  Synthetic Oligonucleotide
cctccctctggtggtgcttcctcagggcccaccattgaagaggttgattaagccaaccaagtgtagatgtagc

SEQ ID NO: 2631 - DNA, 84 bp, Artificial Sequence
  Synthetic Oligonucleotide
ccgactggaggagcataaaagcgcagccgagcccagcgccccgcacttttctgagcagacgtccagagcagagtcagccagcat

SEQ ID NO: 2632 - DNA, 71 bp, Artificial Sequence
  Synthetic Oligonucleotide
caaaaggcagaggctgataagaacgacaagtctgtgaaggatctggtcatcttgctttatgaaactgcgct

SEQ ID NO: 2633 - DNA, 78 bp, Artificial Sequence
  Synthetic Oligonucleotide
gcaagcaacagtagtcgctgttggatcgggttctaaaggaaagggtggagagattcaaccagttagcgtgaaagttgg

SEQ ID NO: 2634 - DNA, 66 bp, Artificial Sequence
  Synthetic Oligonucleotide
gagtacgtgtgccgagtgttgggcagctccgtgcctctagaggcctctgtcctggtcaccattgag

SEQ ID NO: 2635 - DNA, 68 bp, Artificial Sequence
  Synthetic Oligonucleotide
gcagacagtgaccatctacagctttccggcgcccaacgtgattctgacgaagccagaggtctcagaag

SEQ ID NO: 2636 - DNA, 62 bp, Artificial Sequence
  Synthetic Oligonucleotide
ggtcatcctgacactgcaacccactttggtggctgtgggcaagtccttcaccattgagtgca

SEQ ID NO: 2637 - DNA, 70 bp, Artificial Sequence
  Synthetic Oligonucleotide
agaaccgcaaggtgagcaaggtggagattctccagcacgtcatcgactacatcagggaccttcagttgga

SEQ ID NO: 2638 - DNA, 76 bp, Artificial Sequence
  Synthetic Oligonucleotide
aacgactgctactccaagctcaaggagctggtgcccagcatcccccagaacaagaaggtgagcaagatggaaatcc

SEQ ID NO: 2639 - DNA, 80 bp, Artificial Sequence
  Synthetic Oligonucleotide
cttcaccaaatcccttcctggagactaaacctggtgctcaggagcgaaggactgtgaacttgtagcctgaagagccagag

SEQ ID NO: 2640 - DNA, 83 bp, Artificial Sequence
  Synthetic Oligonucleotide
tggcctggctcttaatttgcttttgttttgcccagtatagactcggaagtaacagttatagctagtggtcttgcatgattgca

SEQ ID NO: 2641 - DNA, 76 bp, Artificial Sequence
  Synthetic Oligonucleotide
tgacaaccaagcaaatgtgaggagtctggtgacctggggcaactttgcctggatgtattaccacatgggcagactg

SEQ ID NO: 2642 - DNA, 76 bp, Artificial Sequence
  Synthetic Oligonucleotide
tccggagctgtgatctaaggaggctggagatgtattgcgcacccctcaagcctgccaagtcagctcgctctgtccg

SEQ ID NO: 2643 - DNA, 83 bp, Artificial Sequence
  Synthetic Oligonucleotide
gcatggtagccgaagatttcacagtcaaaatcggagattttggtatgacgcgagatatctatgagacagactattaccggaaa

SEQ ID NO: 2644 - DNA, 72 bp, Artificial Sequence
  Synthetic Oligonucleotide
ccgtgcttccggacaacttccccagataccccgtgggcaagttcttccaatatgacacctggaagcagtcca

SEQ ID NO: 2645 - DNA, 73 bp, Artificial Sequence
  Synthetic Oligonucleotide
gtggacagcaccatgaacatgttgggcgggggaggcagtgctggccggaagcccctcaagtcgggtatgaagg

SEQ ID NO: 2646 - DNA, 68 bp, Artificial Sequence
  Synthetic Oligonucleotide
acgcaccgggtgtctgatcccaagttccaccccctccattcaaagataatcatcatcaagaaagggca

SEQ ID NO: 2647 - DNA, 69 bp, Artificial Sequence
  Synthetic Oligonucleotide
tggacaagtacgggatgaagctgccaggcatggagtacgttgacggggactttcagtgccacaccttcg

SEQ ID NO: 2648 - DNA, 77 bp, Artificial Sequence
  Synthetic Oligonucleotide
tgaaccgcagagaccaacagaggaatccaggcacctctaccacgccctcccagcccaattctgcgggtgtccaagac

SEQ ID NO: 2649 - DNA, 68 bp, Artificial Sequence
  Synthetic Oligonucleotide
gggtcactatggagttcaaaggacagaactcctgcctggtgaccgggacaacctggccattcagaccc

SEQ ID NO: 2650 - DNA, 76 bp, Artificial Sequence
  Synthetic Oligonucleotide
aaggacgaggagaacacaggcgccgaccgcctcatgacccagcgctgcaaggaccgcctgaactcgctggctatct

SEQ ID NO: 2651 - DNA, 70 bp, Artificial Sequence
  Synthetic Oligonucleotide
aaggaaccatctcactgtgtgtaaacatgacttccaagctggccgtggctctcttggcagccttcctgat

SEQ ID NO: 2652 - DNA, 79 bp, Artificial Sequence
  Synthetic Oligonucleotide
ggcgctgtcatcgatttcttccctgtgaaaacaagagcaaggccgtggagcaggtgaagaatgcctttaataagctcca

SEQ ID NO: 2653 - DNA, 67 bp, Artificial Sequence
  Synthetic Oligonucleotide
agctgaggaagatgctggttccctgcccacagaccttccaggagaatgacctgagcaccttctttcc

SEQ ID NO: 2654 - DNA, 72 bp, Artificial Sequence
  Synthetic Oligonucleotide
cctgaaccttccaaagatggctgaaaaagatggatgcttccaatctggattcaatgaggagacttgcctggt

SEQ ID NO: 2655 - DNA, 74 bp, Artificial Sequence
  Synthetic Oligonucleotide
ggcctaatgttccagatccttcaaagagtcatattgcccagtggtcacctcacactcctccaaggcacaatttt

SEQ ID NO: 2656 - DNA, 63 bp, Artificial Sequence
  Synthetic Oligonucleotide
agccatcactctcagtgcagccaggtcctatcgtggcccctgaggagaccctgactctgcagt

SEQ ID NO: 2657 - DNA, 67 bp, Artificial Sequence
  Synthetic Oligonucleotide
gaaagtgtttgcggagcacaagatctcctacagcggccagttcttggtcaaatccggctacgccttc

SEQ ID NO: 2658 - DNA, 81 bp, Artificial Sequence
  Synthetic Oligonucleotide
caatctgatcccagggttgaacctcagcgcacttggcatcttttcaacaggactgtccgtgctatctccaccagcagggcc

SEQ ID NO: 2659 - DNA, 72 bp, Artificial Sequence
  Synthetic Oligonucleotide
tgtttccaagatcctgctgaaagtgaacgagcctcagataaagcaaagatggattccagccaaccagaaaga

SEQ ID NO: 2660 - DNA, 65 bp, Artificial Sequence
  Synthetic Oligonucleotide
cctacagcaagtgcaaggaatacagtgacgacaaagtgcagctggccatgcagacctacgagatg

SEQ ID NO: 2661 - DNA, 78 bp, Artificial Sequence
  Synthetic Oligonucleotide
cctcccagtttcatcttccactactgtcatggtggttgtgggctgcacatcccaccaaacctgtcccttccagtccct

SEQ ID NO: 2662 - DNA, 72 bp, Artificial Sequence
  Synthetic Oligonucleotide
gtgcccgagccatatagcaggcacgtccgggtcctcactgtccttccactcaacagtcatcaaccactaccg

SEQ ID NO: 2663 - DNA, 72 bp, Artificial Sequence
  Synthetic Oligonucleotide
agcctccaggataccagcaaatggatgcggtgacaaatggcagcttagctacaaatgcctgtcagtcggaga

SEQ ID NO: 2664 - DNA, 74 bp, Artificial Sequence
  Synthetic Oligonucleotide
ccacagctcaccttctgtcaggtgtccatcccagctccagccagctcccagagaggaagagactggcactgagg

SEQ ID NO: 2665 - DNA, 77 bp, Artificial Sequence
  Synthetic Oligonucleotide
ccatgatcctcactctgctggtggactatacactccagacctcgcttagcatggtaaatcaccggctacaaagcttc

SEQ ID NO: 2666 - DNA, 66 bp, Artificial Sequence
  Synthetic Oligonucleotide
caacgcttcagtgatcaatcccggggcgatttacagatgcaggatcggaaagaatcccggccagac

SEQ ID NO: 2667 - DNA, 75 bp, Artificial Sequence
  Synthetic Oligonucleotide
aggccagccctacattatcagagcaagagccggatagaggacaaggctcagatcttgctggactgtggagaagac

SEQ ID NO: 2668 - DNA, 69 bp, Artificial Sequence
  Synthetic Oligonucleotide
cagtgacaaacagcccttccaacccaaggaatcccacaaaagatggcgatgacgcccatgaggctaaac

SEQ ID NO: 2669 - DNA, 79 bp, Artificial Sequence
  Synthetic Oligonucleotide
gatatgattggtcgctgctttgtgctcagccaggacctggccatccgggatgagttggatggtggggaatggaagttct

SEQ ID NO: 2670 - DNA, 79 bp, Artificial Sequence
  Synthetic Oligonucleotide
actcggactgcacaagctatttttgatgacagctatttgggttattctgtggctgtcggagatttcaatggtgatggca

SEQ ID NO: 2671 - DNA, 74 bp, Artificial Sequence
  Synthetic Oligonucleotide
tcagaattggatttggctcatttgtggaaaagactgtgatgccttacattagcacaacaccagctaagctcagg

SEQ ID NO: 2672 - DNA, 78 bp, Artificial Sequence
  Synthetic Oligonucleotide
accgggagccctacatgaccgaaaatacctgcaaccgttactgccgtgacgagattgagtcagtgaaagagcttaagg

SEQ ID NO: 2673 - DNA, 66 bp, Artificial Sequence
  Synthetic Oligonucleotide
caaggtgccctcagtggagctcaccaacctgtacccgtattgcgactatgagatgaaggtgtgcgc

SEQ ID NO: 2674 - DNA, 71 bp, Artificial Sequence
  Synthetic Oligonucleotide
tcgtgaaagatgaccaggaggctgtgctatgtttctacaaaaccgccaaggactgcgtcatgatgttcacc

SEQ ID NO: 2675 - DNA, 71 bp, Artificial Sequence
  Synthetic Oligonucleotide
gtcaaaatggggagggactagggcagtttggatagctcaacaagatacaatctcactctgtggtggtcctg

SEQ ID NO: 2676 - DNA, 79 bp, Artificial Sequence
  Synthetic Oligonucleotide
gagcgcaaagtggaaatcgccttctaccggaaagatgggagctgcttcctatgtctggtggatgtggtgcccgtgaaga

SEQ ID NO: 2677 - DNA, 76 bp, Artificial Sequence
  Synthetic Oligonucleotide
tcctgctgctggtcatctacacggctgtcttcacaccctactcggctgccttcctgctgaaggagacggaagaagg

SEQ ID NO: 2678 - DNA, 69 bp, Artificial Sequence
  Synthetic Oligonucleotide
cctatcagccgctggtgtggttctggatcctgctcggcctggcttacttcgcctcagtgctcaccacca

SEQ ID NO: 2679 - DNA, 68 bp, Artificial Sequence
  Synthetic Oligonucleotide
gaggacgaaggcctctacacctgccaggcatgcagtgttcttggctgtgcaaaagtggaggcattttt

SEQ ID NO: 2680 - DNA, 80 bp, Artificial Sequence
  Synthetic Oligonucleotide
cggactttgggtgcgacttgacgagcggtggttcgacaagtggccttgcgggccggatcgtcccagtggaagagttgtaa

SEQ ID NO: 2681 - DNA, 66 bp, Artificial Sequence
  Synthetic Oligonucleotide
gtgtcctggtccatgtggtgcacgtgtctccacctccaaggagaggctcctcagtgtgcacctccc

SEQ ID NO: 2682 - DNA, 67 bp, Artificial Sequence
  Synthetic Oligonucleotide
ctaaggcacttgctggaagggcagaatgccagtgtgcttgcctatggacccacaggagctgggaaga

SEQ ID NO: 2683 - DNA, 73 bp, Artificial Sequence
  Synthetic Oligonucleotide
aattcctgctccaaaagaaagtcttcgaagccgctccactcgcatgtccactgtctcagagcttcgcatcacg

SEQ ID NO: 2684 - DNA, 66 bp, Artificial Sequence
  Synthetic Oligonucleotide
ccacagggttgaagaaccagaagccagttcctgctgttcctgtccagaagtctggcacatcaggtg

SEQ ID NO: 2685 - DNA, 79 bp, Artificial Sequence
  Synthetic Oligonucleotide
gtccccgggatggatgttttgccaagtcattgttggataagcgagatggtagtacaattgtcagacagcttgactgatc

SEQ ID NO: 2686 - DNA, 74 bp, Artificial Sequence
  Synthetic Oligonucleotide
gtgcaaccgcagcttctcgcgctctgaccacctggccctgcatatgaagaggcaccagaactgagcactgcccg

SEQ ID NO: 2687 - DNA, 67 bp, Artificial Sequence
  Synthetic Oligonucleotide
cacgagaccggctacttctcggcgctgccgtctctggaggagtactggcaacagacctgcctagagc

SEQ ID NO: 2688 - DNA, 78 bp, Artificial Sequence
  Synthetic Oligonucleotide
gcccagaggctccatcgtccatcctcttcctccccagtcggctgaactctccccttgtctgcactgttcaaacctctg

SEQ ID NO: 2689 - DNA, 78 bp, Artificial Sequence
  Synthetic Oligonucleotide
gacgtgagggtcctgattctccctggttttaccccagctccatccttgcatcactggggaggacgtgatgagtgagga

SEQ ID NO: 2690 - DNA, 70 bp, Artificial Sequence
  Synthetic Oligonucleotide
tgagagccaggcttcttgtatgtctcaaaatgccagccttctgaaagtatacagcaaagaggaccaggat

SEQ ID NO: 2691 - DNA, 71 bp, Artificial Sequence
  Synthetic Oligonucleotide
atgtgccagtgagcttgagtccttggagaaacacaagcacctgctagaaagtactgttaaccaggggctca

SEQ ID NO: 2692 - DNA, 72 bp, Artificial Sequence
  Synthetic Oligonucleotide
gagaccaaggttgcaaggccaggccctgtgtgaacctttgagctttcatagagagtttcacagcatggactg

SEQ ID NO: 2693 - DNA, 77 bp, Artificial Sequence
  Synthetic Oligonucleotide
tgagcggcagaatcaggagtaccagcggctcatggacatcaagtcgcggctggagcaggagattgccacctaccgca

SEQ ID NO: 2694 - DNA, 86 bp, Artificial Sequence
  Synthetic Oligonucleotide
ggatgaagcttacatgaacaaggtagagctggagtctcgcctggaagggctgaccgacgagatcaacttcctcaggcagctatatg

SEQ ID NO: 2695 - DNA, 73 bp, Artificial Sequence
  Synthetic Oligonucleotide
cagatgaggcacatggagacccaggccaaggacctgaggaatcagttgctcaactaccgttctgccatttcaa

SEQ ID NO: 2696 - DNA, 67 bp, Artificial Sequence
  Synthetic Oligonucleotide
actgaccaagcctgagacctactgcacccagtatggcgagtggcagatgaaatgctgcaagtgtgac

SEQ ID NO: 2697 - DNA, 80 bp, Artificial Sequence
  Synthetic Oligonucleotide
actcaagcggaaattgaagcagataggtcttatcagcacagtctccgcctcctggattcagtgtctcggcttcagggagt

SEQ ID NO: 2698 - DNA, 68 bp, Artificial Sequence
  Synthetic Oligonucleotide
gtgaacgttccggagagcggggagagcgcagaagcgtctctggatggcagccgggagtatgtgaatgt

SEQ ID NO: 2699 - DNA, 80 bp, Artificial Sequence
  Synthetic Oligonucleotide
cgctgggcaacattaagagttaccctggattaacgagttacctcgtccgagtggtgagcaccaactacaaccagcatgct

SEQ ID NO: 2700 - DNA, 67 bp, Artificial Sequence
  Synthetic Oligonucleotide
cagtgcctctcgcctgtcgactgggacaagcctgacagcagcggcacagagcaggatgacctcttca

SEQ ID NO: 2701 - DNA, 66 bp, Artificial Sequence
  Synthetic Oligonucleotide
gatgacggaaagcatccagatggaggcctctacaacaagggaccctcctactcgagttattccggg

SEQ ID NO: 2702 - DNA, 69 bp, Artificial Sequence
  Synthetic Oligonucleotide
agcggaaaatggcagacaatttttcgctccatgatgcgttatctgggtctggaaacccaaaccctcaag

SEQ ID NO: 2703 - DNA, 67 bp, Artificial Sequence
  Synthetic Oligonucleotide
ttggtgccgttcctatagatgatcctgaagatggaggcaagcactgggtggtgatcgtggcaggttc

SEQ ID NO: 2704 - DNA, 67 bp, Artificial Sequence
  Synthetic Oligonucleotide
cacctggtctgggaagatacctggaggttttgattggggtctcggtggccttcgtcctgctgctctt

SEQ ID NO: 2705 - DNA, 66 bp, Artificial Sequence
  Synthetic Oligonucleotide
tgcaaacgctggtgtcacagccagccccccaactgacctcatctggaagaaccagaactcgtgggg

SEQ ID NO: 2706 - DNA, 71 bp, Artificial Sequence
  Synthetic Oligonucleotide
cccatccagaacactgattgctgtcattcaagtgaaagggatggaggtcagaaagggtgcatagaaagcag

SEQ ID NO: 2707 - DNA, 66 bp, Artificial Sequence
  Synthetic Oligonucleotide
ccaatgggagaacaacgggcaggtgttcagcttgctgagcctgggctcacagtaccagcctcagcg

SEQ ID NO: 2708 - DNA, 66 bp, Artificial Sequence
  Synthetic Oligonucleotide
tcagcgggctcttaaacaaccagctgtccccgcagtaaagaagcctgcgtggtcaactcctgtctt

SEQ ID NO: 2709 - DNA, 67 bp, Artificial Sequence
  Synthetic Oligonucleotide
cgactatgacccactggacaagttcatctactgggtggatgggcgccagaacatcaagcgagccaag

SEQ ID NO: 2710 - DNA, 68 bp, Artificial Sequence
  Synthetic Oligonucleotide
ggatgtagccatctctgcctctatagacctcagggccttcgctgtgcttgccctattggctttgaact

SEQ ID NO: 2711 - DNA, 68 bp, Artificial Sequence
  Synthetic Oligonucleotide
aatgctgatgacttggagcaggccccacagaccccacagaggatgaagccaccccacagaggatgcag

SEQ ID NO: 2712 - DNA, 74 bp, Artificial Sequence
  Synthetic Oligonucleotide
tggttctgattaggtaacgtattggacctgcccacaactcccttgcacgtaaacttcagtgtcccaccttgacc

SEQ ID NO: 2713 - DNA, 67 bp, Artificial Sequence
  Synthetic Oligonucleotide
agaagctgtccctgcaagagcaggatgcagcgattgtgaagaacatgaagtctgagctggtacggct

SEQ ID NO: 2714 - DNA, 75 bp, Artificial Sequence
  Synthetic Oligonucleotide
ccgggagcagggaatcaccctgcgcgggagcgccgaaatcgtggccgagttcttctcattcggcatcaacagcat

SEQ ID NO: 2715 - DNA, 70 bp, Artificial Sequence
  Synthetic Oligonucleotide
gctgcctttggtaagaacatgtcgtccatcttgccattcacgccgccagttgtgaagagactgctgggat

SEQ ID NO: 2716 - DNA, 76 bp, Artificial Sequence
  Synthetic Oligonucleotide
ggacattactggcctgttcacaatgagcttgcattccagcctcccatttccaatcatcctgctcctgagtattggt

SEQ ID NO: 2717 - DNA, 72 bp, Artificial Sequence
  Synthetic Oligonucleotide
tccatcaaggctttcgactacgagaaggcgtacagcctgcagcggcccaatgaccacgagtttatgcagcag

SEQ ID NO: 2718 - DNA, 67 bp, Artificial Sequence
  Synthetic Oligonucleotide
cggaccaccaggtcagagccaattcgcagagcagggaagagtggtacctcaacacccactacccctg

SEQ ID NO: 2719 - DNA, 76 bp, Artificial Sequence
  Synthetic Oligonucleotide
gcctttcttacccagaagcagaaggtgggagaactgaaggatgacgactttgagaagatcagtgagctgggggctg

SEQ ID NO: 2720 - DNA, 71 bp, Artificial Sequence
  Synthetic Oligonucleotide
ggttggcatcaaaaggaactggtgcaggagagtttcagggacaattactggggacaattgcatttatggca

SEQ ID NO: 2721 - DNA, 76 bp, Artificial Sequence
  Synthetic Oligonucleotide
tgagtggaaaagcctgacctatgatgaagtcatcagctttgtgccaccaccccttgaccaagaagagatggagtcc

SEQ ID NO: 2722 - DNA, 77 bp, Artificial Sequence
  Synthetic Oligonucleotide
cagatggccactttgagaacattttagctgacaacagtgtgaacgaccagaccaaaatccttgtggttaatgctgcc

SEQ ID NO: 2723 - DNA, 75 bp, Artificial Sequence
  Synthetic Oligonucleotide
caaacgggctcatcataatgcactggaacgaaaacgtagggaccacatcaaagacagctttcacagtttgcggga

SEQ ID NO: 2724 - DNA, 75 bp, Artificial Sequence
  Synthetic Oligonucleotide
gacttttgcccgctacctttcattccggcgtgacaacaatgagctgttgctcttcatactgaagcagttagtggc

SEQ ID NO: 2725 - DNA, 75 bp, Artificial Sequence
  Synthetic Oligonucleotide
ggagaacaatccccttgagacagaatatggcctttctgtctacaaggatcaccagaccatcaccatccaggagat

SEQ ID NO: 2726 - DNA, 82 bp, Artificial Sequence
  Synthetic Oligonucleotide
tgatggtcctatgtgtcacattcatcacaggtttcataccaacacaggcttcagcacttcctttggtgtgtttcctgtccca

SEQ ID NO: 2727 - DNA, 71 bp, Artificial Sequence
  Synthetic Oligonucleotide
cgctcagccagatgcaatcaatgccccagtcacctgctgttataacttcaccaataggaagatctcagtgc

SEQ ID NO: 2728 - DNA, 66 bp, Artificial Sequence
  Synthetic Oligonucleotide
ggagccgactgcaagtacaagtttgagaactggggtgcgtgtgatgggggcacaggcaccaaagtc

SEQ ID NO: 2729 - DNA, 68 bp, Artificial Sequence
  Synthetic Oligonucleotide
ctacagggacgccatcgaatccggatcttgatgctggtgtaagtgaacattcaggtgattggttggat

SEQ ID NO: 2730 - DNA, 74 bp, Artificial Sequence
  Synthetic Oligonucleotide
ggagtcgaaggtggacaatcttgttgtcaatggcaccggaacaaactcaaccaactccactacagctgttccca

SEQ ID NO: 2731 - DNA, 69 bp, Artificial Sequence
  Synthetic Oligonucleotide
gtgaaatgaaacgcaccacactggacagccctttggggaagctggagctgtctggttgtgagcagggtc

SEQ ID NO: 2732 - DNA, 79 bp, Artificial Sequence
  Synthetic Oligonucleotide
acggatctaccacaccattgcatatttgacaccccttccccagccaaatagagctttgagtttttttgttggatatgga

SEQ ID NO: 2733 - DNA, 72 bp, Artificial Sequence
  Synthetic Oligonucleotide
gggagatcatcgggacaactctccttttgatggacctggaggaaatcttgctcatgcttttcaaccaggccc

SEQ ID NO: 2734 - DNA, 78 bp, Artificial Sequence
  Synthetic Oligonucleotide
ccaacgcttgccaaatcctgacaattcagaaccagctctctgtgaccccaatttgagttttgatgctgtcactaccgt

SEQ ID NO: 2735 - DNA, 86 bp, Artificial Sequence
  Synthetic Oligonucleotide
ccatgatggagaggcagacatcatgatcaactttggccgctgggagcatggcgatggatacccctttgacggtaaggacggactcc

SEQ ID NO: 2736 - DNA, 79 bp, Artificial Sequence
  Synthetic Oligonucleotide
ggatggtagcagtctagggattaacttcctgtatgctgcaactcatgaacttggccattctttgggtatgggacattcc

SEQ ID NO: 2737 - DNA, 67 bp, Artificial Sequence
  Synthetic Oligonucleotide
gagaaccaatctcaccgacaggcagctggcagaggaatacctgtaccgctatggttacactcgggtg

SEQ ID NO: 2738 - DNA, 79 bp, Artificial Sequence
  Synthetic Oligonucleotide
tcatggtgcccgtcaatgctgtgatggcgatgaagaccaagacgtatcaggtggcccacatgaagagcaaagacaatcg

SEQ ID NO: 2739 - DNA, 65 bp, Artificial Sequence
  Synthetic Oligonucleotide
aggggatgacttggacacatctgccattcgacatgactgcaattttgacaaagccatgcagtttt

SEQ ID NO: 2740 - DNA, 91 bp, Artificial Sequence
  Synthetic Oligonucleotide
tcatcctggcgatctacttcctctggcagaacctaggtccctctgtcctggctggagtcgctttcatggtcttgctgattccactcaacgg

SEQ ID NO: 2741 - DNA, 66 bp, Artificial Sequence
  Synthetic Oligonucleotide
agcgcctggaatctacaactcggagtccagtgttttcccacttgtcatcttctctccaggggctct

SEQ ID NO: 2742 - DNA, 66 bp, Artificial Sequence
  Synthetic Oligonucleotide
acttgcaggctgctatccttaacatgctgcccctgagagtaggaatgaccagggttcaagtctgct

SEQ ID NO: 2743 - DNA, 73 bp, Artificial Sequence
  Synthetic Oligonucleotide
gatgcagaattgaggcagactttacaagaagatttacttcgtcgattcccagatcttaaccgacttgccaaga

SEQ ID NO: 2744 - DNA, 82 bp, Artificial Sequence
  Synthetic Oligonucleotide
tgattaccatcatggctcagattggctcctatgttcctgcagaagaagcgacaattgggattgtggatggcattttcacaag

SEQ ID NO: 2745 - DNA, 68 bp, Artificial Sequence
  Synthetic Oligonucleotide
tctattgggggattggtaggaaccgttaccagctggaaattcctgagaatttcaccactcgcaatttg

SEQ ID NO: 2746 - DNA, 72 bp, Artificial Sequence
  Synthetic Oligonucleotide
gtgtgagaagtgtgccaaggactgtgtgtgcaaaggcggagaggcagctgaggcagaagcagagaagtgcag

SEQ ID NO: 2747 - DNA, 77 bp, Artificial Sequence
  Synthetic Oligonucleotide
ccgccctcacctgaagagaaacgcgctccttggcggacactgggggaggagaggaagaagcgcggctaacttattcc

SEQ ID NO: 2748 - DNA, 71 bp, Artificial Sequence
  Synthetic Oligonucleotide
ggccaggatctgtggtggtacaattgactctggccttccgagaaggtaccatcaatgtccacgacgtggag

SEQ ID NO: 2749 - DNA, 66 bp, Artificial Sequence
  Synthetic Oligonucleotide
ctatgagccatgtgggaaccggagcttcgagacctgcaggaccatcaacggcatccactccaacat

SEQ ID NO: 2750 - DNA, 67 bp, Artificial Sequence
  Synthetic Oligonucleotide
tgcccttgcactgtcctaacggctcagccatcctgcacacctacacccacgtggatgagtgtggctg

SEQ ID NO: 2751 - DNA, 67 bp, Artificial Sequence
  Synthetic Oligonucleotide
gtacgaccaagagaaacgggacctaccatggagaagacgggcagaagatgagatggacctggacagg

SEQ ID NO: 2752 - DNA, 75 bp, Artificial Sequence
  Synthetic Oligonucleotide
acgagaacgagggcatctatgtgcaggatgtcaagaccggaaaggtgcgcgctgtgattggaagcacctacatgc

SEQ ID NO: 2753 - DNA, 78 bp, Artificial Sequence
  Synthetic Oligonucleotide
gaaggaatgggaatcagtcatgagctaatcaccctggagatcagctcccgagatgtcccggatctgactctaatagac

SEQ ID NO: 2754 - DNA, 74 bp, Artificial Sequence
  Synthetic Oligonucleotide
agaaactggaggagcaggaccgccgggcactgagcatcaaggagcagctgcagcaggagcatcgtttcctgaag

SEQ ID NO: 2755 - DNA, 74 bp, Artificial Sequence
  Synthetic Oligonucleotide
gccgagatcgccaagatgttgccagggaggacagacaatgctgtgaagaatcactggaactctaccatcaaaag

SEQ ID NO: 2756 - DNA, 85 bp, Artificial Sequence
  Synthetic Oligonucleotide
cggtacttctcagggctaatatatacgtactctggcctcttctgcgtggtggtcaacccctataaacacctgcccatctactcgg

SEQ ID NO: 2757 - DNA, 73 bp, Artificial Sequence
  Synthetic Oligonucleotide
tgacggagcgtgagtgcatcaagtacatgcggcagatctcggagggagtggagtacatccacaagcagggcat

SEQ ID NO: 2758 - DNA, 73 bp, Artificial Sequence
  Synthetic Oligonucleotide
taactgacattcttgagcaccagatccgggctgttccctttgagaaccttaacatgcattgtgggcaagccat

SEQ ID NO: 2759 - DNA, 67 bp, Artificial Sequence
  Synthetic Oligonucleotide
ctctcccagcacagcttgaacctcactgagtcaaccagcctggacatgttgctggatgacactggtg

SEQ ID NO: 2760 - DNA, 77 bp, Artificial Sequence
  Synthetic Oligonucleotide
tagttcccagctgaccatcaaaaaggtggataagaacgacgaggctgagtacatctgcattgctgagaacaaggctg

SEQ ID NO: 2761 - DNA, 69 bp, Artificial Sequence
  Synthetic Oligonucleotide
ctactgcggaaagtcggggcactggagtccaaactcgcttcctgccggaacctcgtgtacgatcagtcc

SEQ ID NO: 2762 - DNA, 67 bp, Artificial Sequence
  Synthetic Oligonucleotide
agggcaacattccacagctgccctggctgtgatgagtgtccttgcaggggccggagtaggagcactg

SEQ ID NO: 2763 - DNA, 66 bp, Artificial Sequence
  Synthetic Oligonucleotide
tatccatcctgatggcgtcatcccagtgctgactttcctcagggatcacaccaatgcacagttcaa

SEQ ID NO: 2764 - DNA, 69 bp, Artificial Sequence
  Synthetic Oligonucleotide
tgctggctactgggtgttagtttgcagtcctgtgtgcttccctctcttatgactgtgtccctggttgtc

SEQ ID NO: 2765 - DNA, 79 bp, Artificial Sequence
  Synthetic Oligonucleotide
gtgaggcagcgcgactctggcgactggccggccatgccttcccgggctgaggactatgaagtgttgtacaccattggca

SEQ ID NO: 2766 - DNA, 68 bp, Artificial Sequence
  Synthetic Oligonucleotide
actccagagctgacctccaccgcccagcctgggaagtcattgtagggagtgagacactgaagccctga

SEQ ID NO: 2767 - DNA, 73 bp, Artificial Sequence
  Synthetic Oligonucleotide
cagaccaaggagatggacctcagcgtggtgcggctcatgtttacagcttttcttccggatagcactggcagct

SEQ ID NO: 2768 - DNA, 68 bp, Artificial Sequence
  Synthetic Oligonucleotide
ctgccgggatggcttctatgaggctgagctctgcccggaccgctgcatccacagtttccagaacctgg

SEQ ID NO: 2769 - DNA, 78 bp, Artificial Sequence
  Synthetic Oligonucleotide
ccaaggaatcatgttcgttcaggaggaggccctggccagcagcctctcgtccactgacagtctgactcccgagcacca

SEQ ID NO: 2770 - DNA, 67 bp, Artificial Sequence
  Synthetic Oligonucleotide
gagagagtgagcgaaccctgcccaggctccaagaagcagctgaagtttgaagagctccagtgcgacg

SEQ ID NO: 2771 - DNA, 70 bp, Artificial Sequence
  Synthetic Oligonucleotide
ggctgctggtacaaatactgcagaaatgacaccaataataggggcagacacaacagcgtggcttagattg

SEQ ID NO: 2772 - DNA, 83 bp, Artificial Sequence
  Synthetic Oligonucleotide
tgatccatctctaggccacatgattgtcaccttagttgcccgggttctcagttttggcaattcttgtgtcaacccatttgctc

SEQ ID NO: 2773 - DNA, 74 bp, Artificial Sequence
  Synthetic Oligonucleotide
ccaaccctgcagactccaagcctgggaccatccgtggagacttctgcatacaagttggcaggaacattatacat

SEQ ID NO: 2774 - DNA, 68 bp, Artificial Sequence
  Synthetic Oligonucleotide
atctccgcctcgctcatgggcacggtgatggcgaagcgagtgaaggcgacaatcctgtatggctccga

SEQ ID NO: 2775 - DNA, 76 bp, Artificial Sequence
  Synthetic Oligonucleotide
cgggtccaccagtttgaatggtcaatgcgagtggctgtcccggctgcagagcggcatggtgccgaaccaatacaac

SEQ ID NO: 2776 - DNA, 75 bp, Artificial Sequence
  Synthetic Oligonucleotide
cacttccctgctgggattatatcaacaaccagtgtgatgagctgtgcaacacggtcgagtgcctgtttgacaact

SEQ ID NO: 2777 - DNA, 84 bp, Artificial Sequence
  Synthetic Oligonucleotide
aatgttgtccaggttctattgccaagaatgtgttgtccaaaatgcctgtttagtttttaaagatggaactccaccctttgcttg

SEQ ID NO: 2778 - DNA, 69 bp, Artificial Sequence
  Synthetic Oligonucleotide
cacagcttgcttgtcgatgtccctgccttcgcctgcctctctgcccttgtcctcatcaccgaccggcat

SEQ ID NO: 2779 - DNA, 83 bp, Artificial Sequence
  Synthetic Oligonucleotide
cgagactctcctcatagtgaaaggtatgtgtcagccatgaccaccccggctcgtatgtcacctgtagatttccacacgccaag

SEQ ID NO: 2780 - DNA, 82 bp, Artificial Sequence
  Synthetic Oligonucleotide
cagctctctccacgcgattcatcaggatctaccccgagagagccactcatggcggactggggctcagaatggagctgctggg

SEQ ID NO: 2781 - DNA, 76 bp, Artificial Sequence
  Synthetic Oligonucleotide
ctacagcctaaacggcaaggactgggaatacattcaggaccccaggacccagcagccaaagctgttcgaagggaac

SEQ ID NO: 2782 - DNA, 69 bp, Artificial Sequence
  Synthetic Oligonucleotide
agaaggactatgccgtccagatccacatcctgaaggcggacaaggcgggggactggtggaagttcacgg

SEQ ID NO: 2783 - DNA, 75 bp, Artificial Sequence
  Synthetic Oligonucleotide
gcttccacatcgtggtattggagacagtcttctgataggtttcctcggcatcagaagtccttcaaccctgcagtt

SEQ ID NO: 2784 - DNA, 80 bp, Artificial Sequence
  Synthetic Oligonucleotide
agagatcaccggcgtaatcaacccagcgttggacaaatactttccgtcagactctggagtgagaatcatagctgagcccg

SEQ ID NO: 2785 - DNA, 80 bp, Artificial Sequence
  Synthetic Oligonucleotide
caaccgaagttttcactccagttgtccccacagtagacacatatgatggccgaggtgatagtgtggtttatggactgagg

SEQ ID NO: 2786 - DNA, 66 bp, Artificial Sequence
  Synthetic Oligonucleotide
tccttgaccataccggagggtgcatgtacatctccggtgtccctgggacagggaagactgccactg

SEQ ID NO: 2787 - DNA, 68 bp, Artificial Sequence
  Synthetic Oligonucleotide
gtttctgaaggggaggtcacagcctgagctggcctcctatgcctcatcatgtcccaaaccagacacct

SEQ ID NO: 2788 - DNA, 77 bp, Artificial Sequence
  Synthetic Oligonucleotide
gctcatcatggtcatgtgctacttgaaaagtcagtggatcaaggagacctgttatcctgacatccctgacccttaca

SEQ ID NO: 2789 - DNA, 72 bp, Artificial Sequence
  Synthetic Oligonucleotide
ccctcgtgctgatgctactgaggagccagcgtctagggcagcagccgcttcctagaagaccaggtcatgatg

SEQ ID NO: 2790 - DNA, 76 bp, Artificial Sequence
  Synthetic Oligonucleotide
gcggaaggtccctcagacatccccgattgaaagaaccagagaggctctgagaaacctcgggaaacttagatcatca

SEQ ID NO: 2791 - DNA, 65 bp, Artificial Sequence
  Synthetic Oligonucleotide
tggagactctcagggtcgaaaacggcggcagaccagcatgacagatttctaccactccaaacgcc

SEQ ID NO: 2792 - DNA, 66 bp, Artificial Sequence
  Synthetic Oligonucleotide
cggtggaccacgaagagttaacccgggacttggagaagcactgcagagacatggaagaggcgagcc

SEQ ID NO: 2793 - DNA, 68 bp, Artificial Sequence
  Synthetic Oligonucleotide
ctttgaacccttgcttgcaataggtgtgcgtcagaagcacccaggacttccatttgctttgtcccggg

SEQ ID NO: 2794 - DNA, 77 bp, Artificial Sequence
  Synthetic Oligonucleotide
cccagctagtgttcctcagaacaaagattggaaaaagctggccgagaaccatttatacatagaggaagggcttacgg

SEQ ID NO: 2795 - DNA, 71 bp, Artificial Sequence
  Synthetic Oligonucleotide
agcagtggcttgctttcttctcctgtgatgtcccagtttcccactctgaagatcccaacatggtcctagca

SEQ ID NO: 2796 - DNA, 81 bp, Artificial Sequence
  Synthetic Oligonucleotide
ccgcaacgtggttttctcaccctatggggtggcctcggtgttggccatgctccagctgacaacaggaggagaaacccagca

SEQ ID NO: 2797 - DNA, 70 bp, Artificial Sequence
  Synthetic Oligonucleotide
gagctgtgggttgttatggaatacttggctggaggctccttgacagatgtggtgacagaaacttgcatgg

SEQ ID NO: 2798 - DNA, 65 bp, Artificial Sequence
  Synthetic Oligonucleotide
ggagctgacctgcttcctacatcgcctggcctcgatgcataaggactatgctgtggtgctctgct

SEQ ID NO: 2799 - DNA, 69 bp, Artificial Sequence
  Synthetic Oligonucleotide
aggtggctgtgttactgcaacgtgccacagttctgcgacagtctacctcggtacgaaaccacacaggtg

SEQ ID NO: 2800 - DNA, 71 bp, Artificial Sequence
  Synthetic Oligonucleotide
gaaggtgttggaggcactcaaggacctcatcaacgaggcctgctgggatattagctccagcggtgtaaacc

SEQ ID NO: 2801 - DNA, 67 bp, Artificial Sequence
  Synthetic Oligonucleotide
ttgttggtgtgccctggtgccgtggtggcggtcactccctctgctgccagtgtttggacagaaccca

SEQ ID NO: 2802 - DNA, 62 bp, Artificial Sequence
  Synthetic Oligonucleotide
actgaaggagacccttggagcctaggggcatcggcaggagagtgtgtgggcagggttattta

SEQ ID NO: 2803 - DNA, 79 bp, Artificial Sequence
  Synthetic Oligonucleotide
agttactaaaaaataccacgaggtccttcagttgagaccaaagaccggtgtcaggggattgcacaaatcactcaccgac

SEQ ID NO: 2804 - DNA, 74 bp, Artificial Sequence
  Synthetic Oligonucleotide
tatcgaggcaggtcataccatgaccggaagtcaaaagttgacctggataggctcaatgatgatgccaagcgtta

SEQ ID NO: 2805 - DNA, 72 bp, Artificial Sequence
  Synthetic Oligonucleotide
gggagtttccaagagatggactagtgcttggtcgggtcttggggtctggagcgtttgggaaggtggttgaag

SEQ ID NO: 2806 - DNA, 66 bp, Artificial Sequence
  Synthetic Oligonucleotide
ccagctctccttccagctacagatcaatgtccctgtccgagtgctggagctaagtgagagccaccc

SEQ ID NO: 2807 - DNA, 68 bp, Artificial Sequence
  Synthetic Oligonucleotide
ggaaaacgttcgtcaacatcacgccagctgaggtgggtgtcctggttggcaaagaccggtcaagtttt

SEQ ID NO: 2808 - DNA, 82 bp, Artificial Sequence
  Synthetic Oligonucleotide
tctatacgtcgatggtgactgcacaatggacatccggacaaagagtcaaggtggggagccaacatacaatgtggctgtcggc

SEQ ID NO: 2809 - DNA, 74 bp, Artificial Sequence
  Synthetic Oligonucleotide
agagccagttgctgtagaactcaaatctctgctgggcaaggatgttctgttcttgaaggactgtgtaggcccag

SEQ ID NO: 2810 - DNA, 98 bp, Artificial Sequence
  Synthetic Oligonucleotide
tgctacctggacagcccgttggtgcgcttcctcctgaaacgagctgtgtctgacttgagagtgactcactacttcttctggttactgaaggacggcct

SEQ ID NO: 2811 - DNA, 83 bp, Artificial Sequence
  Synthetic Oligonucleotide
ataccaatcaccgcacaaacccaggctatttgttaagtccagtcacagcgcaaagaaacatatgcggagaaaatgctagtgtg

SEQ ID NO: 2812 - DNA, 67 bp, Artificial Sequence
  Synthetic Oligonucleotide
gtgattgaagagcatgccaattggtctgtatcccgagaagcaggatttagctattcccacgcaggac

SEQ ID NO: 2813 - DNA, 67 bp, Artificial Sequence
  Synthetic Oligonucleotide
ctgctcaaggacaccgtctacacggacttcgatgggacccgagtgtatagccctccagagtggatcc

SEQ ID NO: 2814 - DNA, 68 bp, Artificial Sequence
  Synthetic Oligonucleotide
gatcaacggctacatccagaagatcaagtcgggagaggaggactttgagtctctggcctcacagttca

SEQ ID NO: 2815 - DNA, 68 bp, Artificial Sequence
  Synthetic Oligonucleotide
cagcaccagcgattacgacgttggctgggagagtcctcacaatggctcggggacgtgggcctattcag

SEQ ID NO: 2816 - DNA, 68 bp, Artificial Sequence
  Synthetic Oligonucleotide
ccgcctggacattgattcaccacccatcacagcccggaacactggcatcatctgtaccattggcccag

SEQ ID NO: 2817 - DNA, 79 bp, Artificial Sequence
  Synthetic Oligonucleotide
gcatccctcacccatcctagaggccaggcaggagcccttctatacccacccagaatgagacatccagcagatttccagc

SEQ ID NO: 2818 - DNA, 76 bp, Artificial Sequence
  Synthetic Oligonucleotide
cccatggatgctcctctgaagagactttcctcattgactgccgaggccccatgaatcaatgtctggtagccaccgg

SEQ ID NO: 2819 - DNA, 69 bp, Artificial Sequence
  Synthetic Oligonucleotide
aatgaatacagtattcccaagcacatcaaccccgtggccgcctccctcatccagaagatgcttcagaca

SEQ ID NO: 2820 - DNA, 66 bp, Artificial Sequence
  Synthetic Oligonucleotide
tgaaggagacgtaccgctgcatcaagcaggttcactacacgctgcctgccagcctctcactgcctg

SEQ ID NO: 2821 - DNA, 84 bp, Artificial Sequence
  Synthetic Oligonucleotide
cagggaggtggttgcaaatttctaaggtacaattgctctattgagtcaccacgaaaaggctggagcttcatgcatcctgggaga

SEQ ID NO: 2822 - DNA, 77 bp, Artificial Sequence
  Synthetic Oligonucleotide
cttacggttttcgtggagaagccttggggtcaatttgttgtatagctgaggttttaattacaacaagaacggctgct

SEQ ID NO: 2823 - DNA, 75 bp, Artificial Sequence
  Synthetic Oligonucleotide
gatgtggactgccattcaaaccaggaagataccggatgtaaatttcgagttttgcctcagccaactaatctcgca

SEQ ID NO: 2824 - DNA, 72 bp, Artificial Sequence
  Synthetic Oligonucleotide
tgactttatggagcccaagtttgagtttgctgtgaagttcaatgcactggaattagatgacagcgacttggc

SEQ ID NO: 2825 - DNA, 71 bp, Artificial Sequence
  Synthetic Oligonucleotide
tcctcatttggatgggaaacatgtggtgtttggccaagtaattaaaggaataggagtggcaaggatattgg

SEQ ID NO: 2826 - DNA, 62 bp, Artificial Sequence
  Synthetic Oligonucleotide
gccatccgcaaaggctttctcgcttgtcaccttgccatgtggaagaaactggcggaatggcc

SEQ ID NO: 2827 - DNA, 74 bp, Artificial Sequence
  Synthetic Oligonucleotide
ggctcagagcataaggcttcagggcccaagttgggagaagtgaccaaagtgtagccagttttctgagttcccgt

SEQ ID NO: 2828 - DNA, 85 bp, Artificial Sequence
  Synthetic Oligonucleotide
gcatcaggctgtcattatggtgtccttacctgtgggagctgtaaggtcttctttaagagggcaatggaagggcagcacaactact

SEQ ID NO: 2829 - DNA, 69 bp, Artificial Sequence
  Synthetic Oligonucleotide
ggtgtccttcgccagatcactgttaatgatttgcctgtgggacgctccgtggatgaggctctgcggctg

SEQ ID NO: 2830 - DNA, 80 bp, Artificial Sequence
  Synthetic Oligonucleotide
tgaccccaatggagtcatcaagcatttgagcgtcaacgatctcccagtgggccgaagcgtggaagaaaccctccgcttgg

SEQ ID NO: 2831 - DNA, 75 bp, Artificial Sequence
  Synthetic Oligonucleotide
ttacccatttggcctggattaatacccctcgaagacaaggaggacttgggccaataaggattccacttctttcag

SEQ ID NO: 2832 - DNA, 76 bp, Artificial Sequence
  Synthetic Oligonucleotide
ctgtgagccagaggatgtcagctgccaattgtgttttcctgcagcaattccataaacacatcctggtgtcatcaca

SEQ ID NO: 2833 - DNA, 70 bp, Artificial Sequence
  Synthetic Oligonucleotide
caagcaatgcgtcatcaatgtccccagcctctgcggaatggatcacactgagaagagggggcggatttac

SEQ ID NO: 2834 - DNA, 67 bp, Artificial Sequence
  Synthetic Oligonucleotide
gacccagctccactcctgcttccagaccatggaccgcctgtactttgtgatggagtacgtgaatggg

SEQ ID NO: 2835 - DNA, 68 bp, Artificial Sequence
  Synthetic Oligonucleotide
ctgacacttgccgcagagaatccctttctcacccacctcatctgcaccttccagaccaaggaccacct

SEQ ID NO: 2836 - DNA, 84 bp, Artificial Sequence
  Synthetic Oligonucleotide
gcgatacatgagcccagaacagatttcttcgcaagactatggaaaggaagtggacctctacgctttggggctaattcttgctga

SEQ ID NO: 2837 - DNA, 86 bp, Artificial Sequence
  Synthetic Oligonucleotide
gccctcccagtgtgcaaataagggctgctgtttcgacgacaccgttcgtggggtcccctggtgcttctatcctaataccatcgacg

SEQ ID NO: 2838 - DNA, 66 bp, Artificial Sequence
  Synthetic Oligonucleotide
ccacgacaaagccgactacatgcctgaaacaaggctgagaatcccggcagcagagcccatcgagta

SEQ ID NO: 2839 - DNA, 81 bp, Artificial Sequence
  Synthetic Oligonucleotide
tggctaagtgaagatgacaatcatgttgcagcaattcactgtaaagctggaaagggacgaactggtgtaatgatatgtgca

SEQ ID NO: 2840 - DNA, 78 bp, Artificial Sequence
  Synthetic Oligonucleotide
taactggggcaaccttttcttcgcctctgcctttgccttcctggggctcttggcgctgacagtcaccttttcctgcaa

SEQ ID NO: 2841 - DNA, 83 bp, Artificial Sequence
  Synthetic Oligonucleotide
agtgactgggagtgggctagaaggggaccacctgtctgacacctccacaacgtcgctggagctcgattcacggtaacaggctt

SEQ ID NO: 2842 - DNA, 73 bp, Artificial Sequence
  Synthetic Oligonucleotide
cgaggtacaagctgagatcaagaaatcttggagccgctggacactggcactggacttcaagcgaaaggcacgc

SEQ ID NO: 2843 - DNA, 68 bp, Artificial Sequence
  Synthetic Oligonucleotide
gaccggtcgaatgataaggtgtacgagaatgtgacgggcctggtgaaagctgtcatcgagatgtccag

SEQ ID NO: 2844 - DNA, 74 bp, Artificial Sequence
  Synthetic Oligonucleotide
caagcccagccgacctaagtacagaccccctccgcaaaccaacctcctggctccaaagctgcagttccaggttc

SEQ ID NO: 2845 - DNA, 70 bp, Artificial Sequence
  Synthetic Oligonucleotide
aatatttgtgcggggtatgggggtgggtttttaaatctcgtttctcttggacaagcacagggatctcgtt

SEQ ID NO: 2846 - DNA, 68 bp, Artificial Sequence
  Synthetic Oligonucleotide
cctgttctcggcaccttaaattattagaccccggggcagtcaggtgctccggacacccgaaggcaata

SEQ ID NO: 2847 - DNA, 81 bp, Artificial Sequence
  Synthetic Oligonucleotide
cgcttgcctaactcatactttcccgttgacacttgatccacgcagcgtggcactgggacgtaagtggcgcagtctgaatgg

SEQ ID NO: 2848 - DNA, 74 bp, Artificial Sequence
  Synthetic Oligonucleotide
aatgaggaagtttcggatggggctgatccagacagccgaccagctgcgcttctcctacctggctgtgatcgaag

SEQ ID NO: 2849 - DNA, 78 bp, Artificial Sequence
  Synthetic Oligonucleotide
tgttttagctgagggacgtggtgccgacgtccccaaacctagctaggctaagtcaagatcaacattccagggttggta

SEQ ID NO: 2850 - DNA, 75 bp, Artificial Sequence
  Synthetic Oligonucleotide
aacttccggtacctcgttcgtgactacatgaagcagagtcctcccgaatcgccgattctggtgcattgcagtgct

SEQ ID NO: 2851 - DNA, 66 bp, Artificial Sequence
  Synthetic Oligonucleotide
catggcctgatcatggtgtgcccacagcaaatgctgcagaaagtatcctgcagtttgtacacatgg

SEQ ID NO: 2852 - DNA, 74 bp, Artificial Sequence
  Synthetic Oligonucleotide
ggctactctgatctatgttgataaggaaaatggagaaccaggcacccgtgtggttgctaaggatgggctgaagc

SEQ ID NO: 2853 - DNA, 79 bp, Artificial Sequence
  Synthetic Oligonucleotide
cctgcagctgtgggacatcgcggggcaggagcgatttggcaacatgacccgagtatactacaaggaagctgttggtgct

SEQ ID NO: 2854 - DNA, 78 bp, Artificial Sequence
  Synthetic Oligonucleotide
gcgacagctcctctagttccaccatgtccgcgggcggagacttcgggaatccgctgaggaaattcaagctggtgttcc

SEQ ID NO: 2855 - DNA, 66 bp, Artificial Sequence
  Synthetic Oligonucleotide
tgttgtaaatgtctcagcccctcgttcttggtcctgtcccttggaacctttgtacgctttgctcaa

SEQ ID NO: 2856 - DNA, 78 bp, Artificial Sequence
  Synthetic Oligonucleotide
gaacttcttgagcaggagcatacccagggcttcataatcaccttctgttcagcactagatgatattcttgggggtgga

SEQ ID NO: 2857 - DNA, 67 bp, Artificial Sequence
  Synthetic Oligonucleotide
agctagcctcagtgacacacatgacaggttgcactgccgacgttgtgtcaacagccgtcagatccgg

SEQ ID NO: 2858 - DNA, 73 bp, Artificial Sequence
  Synthetic Oligonucleotide
cgtcgtatgcgagagtctgtttccaggatgcctgttagttctcagcacagatattctacacctcacgccttca

SEQ ID NO: 2859 - DNA, 84 bp, Artificial Sequence
  Synthetic Oligonucleotide
ggtgtcagatataaatgtgcaaatgccttcttgctgtcctgtcggtctcagtacgttcactttatagctgctggcaatatcgaa

SEQ ID NO: 2860 - DNA, 73 bp, Artificial Sequence
  Synthetic Oligonucleotide
tccttcagctttcacactgggctcagaaatgaagttgcatgactcttctggaagtcaggtgggaacaggattt

SEQ ID NO: 2861 - DNA, 81 bp, Artificial Sequence
  Synthetic Oligonucleotide
aacatgattatccaagccgctggactgccattgtggacaaaattggcttttatcttcagtccgataacagtgcttgttggc

SEQ ID NO: 2862 - DNA, 79 bp, Artificial Sequence
  Synthetic Oligonucleotide
caagtcagttgagacgccagttgtgtggaggaagtcaggccgccatagaaagaatgatccactttggacgagagctgca

SEQ ID NO: 2863 - DNA, 67 bp, Artificial Sequence
  Synthetic Oligonucleotide
tgtggatgctggattgatttcaccactggtgcagctgctaaatagcaaagaccaggaagtgctgctt

SEQ ID NO: 2864 - DNA, 80 bp, Artificial Sequence
  Synthetic Oligonucleotide
agtctgtgagaaacgaccgaaacaagaagaagaaggaggtgcccaagcccgagtgctctgagagctacacgctgacgccg

SEQ ID NO: 2865 - DNA, 78 bp, Artificial Sequence
  Synthetic Oligonucleotide
tgcctggacatcctgattcttagaatttgcaccaggtataccccagaacaagacaccatgactttctcagacggcctt

SEQ ID NO: 2866 - DNA, 69 bp, Artificial Sequence
  Synthetic Oligonucleotide
agtgggagacacctgacctttctcaagctgagattgagcagaagatcaaggagtacaatgcccagatca

SEQ ID NO: 2867 - DNA, 69 bp, Artificial Sequence
  Synthetic Oligonucleotide
cgagagggagagcaagaccatcatgctgcgcggccttcccatcaccatcacagagagcgatattcgaga

SEQ ID NO: 2868 - DNA, 79 bp, Artificial Sequence
  Synthetic Oligonucleotide
ggaaccacattatggatctttgcatagaatgtcaagctaaccaggcgtccgctacttcagaagagtgtactgtcgcatg

SEQ ID NO: 2869 - DNA, 66 bp, Artificial Sequence
  Synthetic Oligonucleotide
gggctgggtgagaatgtgatggagaggaagaagccggccctggtatccattccggaggatgttgtg

SEQ ID NO: 2870 - DNA, 83 bp, Artificial Sequence
  Synthetic Oligonucleotide
tgctaactcctgcacagccccgtcctcttcctttctgctagcctggctaaatctgctcattatttcagaggggaaacctagca

SEQ ID NO: 2871 - DNA, 96 bp, Artificial Sequence
  Synthetic Oligonucleotide
tcaagaccatcatcactttcattgtctcggacgtgcggggcctgggcctcccggtccgcaagcagttccagttatactccgtgtacttcctgatcc

SEQ ID NO: 2872 - DNA, 67 bp, Artificial Sequence
  Synthetic Oligonucleotide
aagcatgaacaggacttgaccatctttccaacccctggggaagacatttgcaactgacttggggagg

SEQ ID NO: 2873 - DNA, 68 bp, Artificial Sequence
  Synthetic Oligonucleotide
cccgttcggtctgaggaaggccgggacatggcgaaccggatcagtgcctttggctaccttgagtgctc

SEQ ID NO: 2874 - DNA, 74 bp, Artificial Sequence
  Synthetic Oligonucleotide
ccagacgagcgattagaagcggcagcttgtgaggtgaatgatttgggggaagaggaggaggaggaagaggagga

SEQ ID NO: 2875 - DNA, 79 bp, Artificial Sequence
  Synthetic Oligonucleotide
accctggaagagatggatcagaaaaaaagatccgggagtgtgtgatctgtatgatggactttgtttatggggacccaat

SEQ ID NO: 2876 - DNA, 73 bp, Artificial Sequence
  Synthetic Oligonucleotide
tgtgcacataggaatgagcttcagatgcagttggccagcaaagagagtgatattgagcaattgcgtgctaaac

SEQ ID NO: 2877 - DNA, 66 bp, Artificial Sequence
  Synthetic Oligonucleotide
gatccgagaccctcgctcccccatcaacgtggagagcttgctggatggcttaaattccttggtcct

SEQ ID NO: 2878 - DNA, 75 bp, Artificial Sequence
  Synthetic Oligonucleotide
ccattctatcatcaacgggtacaaacgagtcctggccttgtctgtggagacggattacaccttcccacttgctga

SEQ ID NO: 2879 - DNA, 73 bp, Artificial Sequence
  Synthetic Oligonucleotide
cagtcggctttaccctatcgacgcagcgtccccacttggttgaagttgacatctgacgacgtgaaggagcaga

SEQ ID NO: 2880 - DNA, 66 bp, Artificial Sequence
  Synthetic Oligonucleotide
gggctactggcagctacattgctgggactaatggcaattccaatggccttgtaccgatgctgagag

SEQ ID NO: 2881 - DNA, 71 bp, Artificial Sequence
  Synthetic Oligonucleotide
cagcgggattaaacagtcctttaaccagcacagccagttaaaagatgcagcctcactgcttcaacgcagat

SEQ ID NO: 2882 - DNA, 74 bp, Artificial Sequence
  Synthetic Oligonucleotide
gactggagtggtgtttggtgccagcctattcctgctgctttcattgacagtattcagcattgtgagcgtaacag

SEQ ID NO: 2883 - DNA, 69 bp, Artificial Sequence
  Synthetic Oligonucleotide
aacagagacattgccaaccatattggatctgcttgctgtccaaaccagcaaacttcctgggcaaatcac

SEQ ID NO: 2884 - DNA, 66 bp, Artificial Sequence
  Synthetic Oligonucleotide
gctctgttgtgtcctgttgccggctctggccttcctgtgactgactgtgaagtggcttctccgtac

SEQ ID NO: 2885 - DNA, 70 bp, Artificial Sequence
  Synthetic Oligonucleotide
tggacaaggtgatgaaggagctagacgagaatggagacggggaggtggacttccaggagtatgtggtgct

SEQ ID NO: 2886 - DNA, 73 bp, Artificial Sequence
  Synthetic Oligonucleotide
tggctgtgctggtcactaccttccacaagtactcctgccaagagggcgacaagttcaagctgagtaaggggga

SEQ ID NO: 2887 - DNA, 70 bp, Artificial Sequence
  Synthetic Oligonucleotide
gactgctgtcatggcgtgccctctggagaaggccctggatgtgatggtgtccaccttccacaagtactcg

SEQ ID NO: 2888 - DNA, 76 bp, Artificial Sequence
  Synthetic Oligonucleotide
actccctgataaaggggaatttccatgccgtctacagggatgacctgaagaaattgctagagaccgagtgtcctca

SEQ ID NO: 2889 - DNA, 65 bp, Artificial Sequence
  Synthetic Oligonucleotide
ctttgggacagagtgcaagacgatgacttgcaaaatgtcgcagctggaacgcaacatagagacca

SEQ ID NO: 2890 - DNA, 67 bp, Artificial Sequence
  Synthetic Oligonucleotide
agacaaggatgccgtggataaattgctcaaggacctggacgccaatggagatgcccaggtggacttc

SEQ ID NO: 2891 - DNA, 67 bp, Artificial Sequence
  Synthetic Oligonucleotide
ccttttaccactgcctggttgcagaagtgccgaaagagcactggactccggaaggacacagcattgt

SEQ ID NO: 2892 - DNA, 67 bp, Artificial Sequence
  Synthetic Oligonucleotide
ggactcaacgatgggcagatcaagatctgggaggtgcagacagggctcctgcttttgaatctttccg

SEQ ID NO: 2893 - DNA, 76 bp, Artificial Sequence
  Synthetic Oligonucleotide
gaaattgacgaggggtgtcttgggcagagctggctctgagcgcctccatccaaggccaggttctccgttagctcct

SEQ ID NO: 2894 - DNA, 71 bp, Artificial Sequence
  Synthetic Oligonucleotide
gctccaggatgtgtttctgttgtcctcgcgggaccaccggaccccgctgctctatgccgtcttctccacgt

SEQ ID NO: 2895 - DNA, 86 bp, Artificial Sequence
  Synthetic Oligonucleotide
cgcgagcccctcattatacactgggcagcctccccacagcgcatcgaggaatgcgtgctctcaggcaaggatgtcaacggcgagtg

SEQ ID NO: 2896 - DNA, 63 bp, Artificial Sequence
  Synthetic Oligonucleotide
ttccagcccaacacagtgaacactttggcctgcccgctcctctccaacctggcgacccgactc

SEQ ID NO: 2897 - DNA, 66 bp, Artificial Sequence
  Synthetic Oligonucleotide
caagctgaacggtgtgtccgaaagggacctgaagaaatcggtgctgtggctcaaagacagcttgca

SEQ ID NO: 2898 - DNA, 67 bp, Artificial Sequence
  Synthetic Oligonucleotide
tacaggatgaggctgggcattgcctgggacagcctatgtaaggccatgtgccccttgccctaacaac

SEQ ID NO: 2899 - DNA, 77 bp, Artificial Sequence
  Synthetic Oligonucleotide
cagtggagaccagttgggtagtggtgactgggtacgctacaagctctgcatgtgtgctgatgggacgctcttcaagg

SEQ ID NO: 2900 - DNA, 71 bp, Artificial Sequence
  Synthetic Oligonucleotide
ccaacaccttcttggcttctgggacctgtgttcttgctgagcaccctctccggtttgggttgggataacag

SEQ ID NO: 2901 - DNA, 70 bp, Artificial Sequence
  Synthetic Oligonucleotide
gtccaaggcacatatccactgctcggtgaaagcagagaactcggtggcggccaaatcgggaggctgcttc

SEQ ID NO: 2902 - DNA, 77 bp, Artificial Sequence
  Synthetic Oligonucleotide
aacggactccctcaatttgtgcaagatttgcatgaccatggacagaaatatgtcatcatcttggaccctgcaatttc

SEQ ID NO: 2903 - DNA, 67 bp, Artificial Sequence
  Synthetic Oligonucleotide
ttggcattggaactacattcaatccgcggtatcctcggattagttctaggacccccttctccatacc

SEQ ID NO: 2904 - DNA, 65 bp, Artificial Sequence
  Synthetic Oligonucleotide
aaccacagttggaggaggacggcagagacagtttccctccccgctataccaacacccttccttcg

SEQ ID NO: 2905 - DNA, 70 bp, Artificial Sequence
  Synthetic Oligonucleotide
tccagcccaaatcctcctggtggcacatcctaccccagatgctaaagtgattcaaggactccaggacacc

SEQ ID NO: 2906 - DNA, 66 bp, Artificial Sequence
  Synthetic Oligonucleotide
gatggtaggaagggatgtgcccgcctctccacgcactcagctatacctcattcacagctccttgtg

SEQ ID NO: 2907 - DNA, 74 bp, Artificial Sequence
  Synthetic Oligonucleotide
ccagagtcatgctcatccagccccaccagttgcaccagtgcagggacagcagcaatttcagaggctgaaggtgg

SEQ ID NO: 2908 - DNA, 72 bp, Artificial Sequence
  Synthetic Oligonucleotide
agctggggtgtctgtttcatgtggaatacctgacttcaggtcaagggatggtatttatgctcgccttgctgt

SEQ ID NO: 2909 - DNA, 76 bp, Artificial Sequence
  Synthetic Oligonucleotide
ccattgcctttgctttgttcataatttcagcagggcagaataaaaaccatgggaggcaaagaaaggaaatccggaa

SEQ ID NO: 2910 - DNA, 71 bp, Artificial Sequence
  Synthetic Oligonucleotide
agttgcagaatctaagcctggaaggcctgcggctttcggatcccattgtcaatactctcgcaaaaaactca

SEQ ID NO: 2911 - DNA, 64 bp, Artificial Sequence
  Synthetic Oligonucleotide
tctgccagtgctgaattctttgctgacattgccctggctcctatggaagctgctaaggttcgaa

SEQ ID NO: 2912 - DNA, 67 bp, Artificial Sequence
  Synthetic Oligonucleotide
gcctgagtctcctgtgcccacatcccaggcttcaccctgaatggttccatgcctgagggtggagact

SEQ ID NO: 2913 - DNA, 66 bp, Artificial Sequence
  Synthetic Oligonucleotide
ccgttcgaagagtcgtgagggggtgacgggttaagattcggagagagaggtgctagtggctggact

SEQ ID NO: 2914 - DNA, 75 bp, Artificial Sequence
  Synthetic Oligonucleotide
cctgctttcaaccacattgaattgaactcagatcagagtggcaagagcaatgggactcgtttgtgaagctgctct

SEQ ID NO: 2915 - DNA, 70 bp, Artificial Sequence
  Synthetic Oligonucleotide
gcgcagaggccagttaaagtagatcacctcctcgaacccactccggttccccgcaacccacagctcagct

SEQ ID NO: 2916 - DNA, 74 bp, Artificial Sequence
  Synthetic Oligonucleotide
atggccaatgtttgatgcttaacccccccaatttctgtgagatggatggccagtgcaagcgtgacttgaagtgt

SEQ ID NO: 2917 - DNA, 66 bp, Artificial Sequence
  Synthetic Oligonucleotide
agggactgtcctggcacattatgcagatgtcctgggtcttttgcttagactgcggcaaatttgttg

SEQ ID NO: 2918 - DNA, 69 bp, Artificial Sequence
  Synthetic Oligonucleotide
cccaatcggaagcctaactacagcgagctgcaggactctaatccagagtttaccttccagcagccctac

SEQ ID NO: 2919 - DNA, 76 bp, Artificial Sequence
  Synthetic Oligonucleotide
ggctggccaaacataagcagctgcactgcgatgcccagtctagaaaatctttcagctgtaaatactgtgacaagga

SEQ ID NO: 2920 - DNA, 79 bp, Artificial Sequence
  Synthetic Oligonucleotide
ggctggtcggcagagagtagcctgcaacattcggccgtggtttacatgagtttacccctcaatcccaaacctttcctca

SEQ ID NO: 2921 - DNA, 70 bp, Artificial Sequence
  Synthetic Oligonucleotide
tgaagagaggcatgttggagacttgggcaatgtgactgctgacaaagatggtgtggccgatgtgtctatt

SEQ ID NO: 2922 - DNA, 78 bp, Artificial Sequence
  Synthetic Oligonucleotide
gcttgtccaaatcaggatccactgcaaggaacaacaggccttattccactgctggggattgatgtgtgggagcacgct

SEQ ID NO: 2923 - DNA, 65 bp, Artificial Sequence
  Synthetic Oligonucleotide
tctgcaccaaattctccaagaacaccgttaacacctccgcctgcttctggtgcttccagtaccac

SEQ ID NO: 2924 - DNA, 67 bp, Artificial Sequence
  Synthetic Oligonucleotide
tcgtgtgcaagcctgagatgggcctcccctaccaggggcatgactccggtgtgaatctccccgacag

SEQ ID NO: 2925 - DNA, 73 bp, Artificial Sequence
  Synthetic Oligonucleotide
tcttccctgtacactggcagttcggccagctggaccagcaccccattgacgggtacctctcccacaccgagct

SEQ ID NO: 2926 - DNA, 68 bp, Artificial Sequence
  Synthetic Oligonucleotide
aggaatgcagcggattcctctgtcccaagtgctcccagaaggcaggattctgaagaccactccagcga

SEQ ID NO: 2927 - DNA, 77 bp, Artificial Sequence
  Synthetic Oligonucleotide
cagaccagtccctggtcataggtctgaaagggcaatccggacccagcccaagcaactgattgtggatgacttgaagg

SEQ ID NO: 2928 - DNA, 66 bp, Artificial Sequence
  Synthetic Oligonucleotide
tgtggcaagtgcaaatgtaaggagtgcacctacccaaggcctctgccatcagactggatctgcgac

SEQ ID NO: 2929 - DNA, 79 bp, Artificial Sequence
  Synthetic Oligonucleotide
agatggaagaagccaacctggcgagccgagcgaaggcccaggagctgatccaggccaccaaccagatcctcagccacag

SEQ ID NO: 2930 - DNA, 63 bp, Artificial Sequence
  Synthetic Oligonucleotide
tgactgcacatggaacattgaggtgcccaacaaccagcatgtgaaggtgcgcttcaaattctt

SEQ ID NO: 2931 - DNA, 81 bp, Artificial Sequence
  Synthetic Oligonucleotide
gggctcagctttcagaagtgctgagttggcagttttcttctgtcaccaaaagaggtctcaatgtggaccagctgaacatgt

SEQ ID NO: 2932 - DNA, 70 bp, Artificial Sequence
  Synthetic Oligonucleotide
tcacatgccactttggtgtttcataatctcctgggagagattgaccagcagtatagccgcttcctgcaag

SEQ ID NO: 2933 - DNA, 77 bp, Artificial Sequence
  Synthetic Oligonucleotide
gaggcgctcaacatgaaattcaaggccgaagtgcagagcaaccggggcctgaccaaggagaacctcgtgttcctggc

SEQ ID NO: 2934 - DNA, 74 bp, Artificial Sequence
  Synthetic Oligonucleotide
ccagtggtggtgatcgttcatggcagccaggacaacaatgcgacggccactgttctctgggacaatgcttttgc

SEQ ID NO: 2935 - DNA, 72 bp, Artificial Sequence
  Synthetic Oligonucleotide
ctccgaggtgaggaggactctccctcccacatcaaacgcacatcccatgagagtgcataaccagggagaggt

SEQ ID NO: 2936 - DNA, 66 bp, Artificial Sequence
  Synthetic Oligonucleotide
ggactcggagacgctgtgcaggagggccgtcaagatcctcaagaagaagaagttgcgaaggatccc

SEQ ID NO: 2937 - DNA, 69 bp, Artificial Sequence
  Synthetic Oligonucleotide
catcttccaggaggaccactctctgtggcaccctggactacctgccccctgaaatgattgaaggtcgga

SEQ ID NO: 2938 - DNA, 71 bp, Artificial Sequence
  Synthetic Oligonucleotide
aatacccaacgcacaaatgaccgcacgttctctgccccgtttcttgccccagtgtggtttgcattgtctcc

SEQ ID NO: 2939 - DNA, 90 bp, Artificial Sequence
  Synthetic Oligonucleotide
cctggaggctgcaacatacctcaatcctgtcccaggccggatcctcctgaagcccttttcgcagcactgctatcctccaaagccattgta

SEQ ID NO: 2940 - DNA, 74 bp, Artificial Sequence
  Synthetic Oligonucleotide
gaagatccctttcctcctactgttctttctgtgggaagccgagagccacgaagcatcaaggccgaacatcatcc

SEQ ID NO: 2941 - DNA, 80 bp, Artificial Sequence
  Synthetic Oligonucleotide
tgttttgattcccgggcttaccaggtgagaagtgagggaggaagaaggcagtgtcccttttgctagagctgacagctttg

SEQ ID NO: 2942 - DNA, 73 bp, Artificial Sequence
  Synthetic Oligonucleotide
gatggagcaggtggctcagttcctgaaggcggctgaggactctggggtcatcaagactgacatgttccagact

SEQ ID NO: 2943 - DNA, 65 bp, Artificial Sequence
  Synthetic Oligonucleotide
gcccgaaacgccgaatataatcccaagcggtttgctgcggtaatcatgaggataagagagccacg

SEQ ID NO: 2944 - DNA, 67 bp, Artificial Sequence
  Synthetic Oligonucleotide
gaggtcctgagcactgccaggagggacaaaggagcctgtgaacccaggacaagcatggtcccacatc

SEQ ID NO: 2945 - DNA, 67 bp, Artificial Sequence
  Synthetic Oligonucleotide
gcagctgcagtcaacagttcaaagaagtcatggcccaaatccagtgtgcacccctccccattcacag

SEQ ID NO: 2946 - DNA, 68 bp, Artificial Sequence
  Synthetic Oligonucleotide
ccgggacactttccagaagccgcgggactatttcgccgaagtgagaaggcctcaggacagcgcgttct

SEQ ID NO: 2947 - DNA, 67 bp, Artificial Sequence
  Synthetic Oligonucleotide
ccaatcacgacaggaggattcagacacccctaccccacagctctgaccgtcaatgcttccgtgtcca

SEQ ID NO: 2948 - DNA, 80 bp, Artificial Sequence
  Synthetic Oligonucleotide
ctgactgctctgcttaaaggtgaaagtagcaggaacaacaacaaaagccaaccaaaaacaaggtagccagtgcaagacat

SEQ ID NO: 2949 - DNA, 76 bp, Artificial Sequence
  Synthetic Oligonucleotide
acttcggtgctacttaacaacttacatcccagggagcagtacgtggtccgagctagagtcaacaccaaggcccagg

SEQ ID NO: 2950 - DNA, 79 bp, Artificial Sequence
  Synthetic Oligonucleotide
aagaggaacggagcgagtccccgcgcgcggcgcgattccctgagctgtgggacgtgcacccaggactcggctcacacat

SEQ ID NO: 2951 - DNA, 85 bp, Artificial Sequence
  Synthetic Oligonucleotide
gacatggagaacaagctgtttgcggggattcggcgggacgggctgctcctgcgtttggtggatgatttcttgttggtgacacctc

SEQ ID NO: 2952 - DNA, 79 bp, Artificial Sequence
  Synthetic Oligonucleotide
aggcactgttcatctcagtttttctgtccctttgctcccggcaagctttctgctgaaagttcatatctggagcctgatg

SEQ ID NO: 2953 - DNA, 83 bp, Artificial Sequence
  Synthetic Oligonucleotide
ggtgtgccacagaccttcctacttggcctgtaatcacctgtgcagccttttgtgggccttcaaaactctgtcaagaactccgt

SEQ ID NO: 2954 - DNA, 75 bp, Artificial Sequence
  Synthetic Oligonucleotide
accagtcccccagaagactatcctgagcccgaggaagtccccccggaggtgatttccatctacaacagcaccagg

SEQ ID NO: 2955 - DNA, 65 bp, Artificial Sequence
  Synthetic Oligonucleotide
ggatcgagctcttccagatccttcggccagatgagcacattgccaaacagcgctatatcggtggc

SEQ ID NO: 2956 - DNA, 67 bp, Artificial Sequence
  Synthetic Oligonucleotide
gctacgagtgctgtcctggatatgaaaaggtccctggggagaagggctgtccagcagccctaccact

SEQ ID NO: 2957 - DNA, 67 bp, Artificial Sequence
  Synthetic Oligonucleotide
gtcatcacctggccttggtcctgtggaactggcagctgtcattgctggaccagtgtgcttcgtctgc

SEQ ID NO: 2958 - DNA, 66 bp, Artificial Sequence
  Synthetic Oligonucleotide
aacaccaatgggttccatctttctgggctcctgattgctcaagcacagtttggcctgatgaagagg

SEQ ID NO: 2959 - DNA, 85 bp, Artificial Sequence
  Synthetic Oligonucleotide
catccgcaaagtgactgaagagaacaaagagttggccaatgagctgaggcggcctcccctatgctatcacaacggagttcagtac

SEQ ID NO: 2960 - DNA, 67 bp, Artificial Sequence
  Synthetic Oligonucleotide
ggacaagaccctctcaggctgtcccaagctcccaagagcttccagagctctgacccacagcctccaa

SEQ ID NO: 2961 - DNA, 75 bp, Artificial Sequence
  Synthetic Oligonucleotide
tccctgcggtcccagatagcctgaatcctgcccggagtggaactgaagcctgcacagtgtccaccctgttcccac

SEQ ID NO: 2962 - DNA, 69 bp, Artificial Sequence
  Synthetic Oligonucleotide
tcaccctctgtgacttcatcgtgccctgggacaccctgagcaccacccagaagaagagcctgaaccaca

SEQ ID NO: 2963 - DNA, 67 bp, Artificial Sequence
  Synthetic Oligonucleotide
ctacctgccttgctttgtgacttccaagaacgagtgtctctggaccgacatgctctccaatttcggt

SEQ ID NO: 2964 - DNA, 73 bp, Artificial Sequence
  Synthetic Oligonucleotide
actttgctgggacaaaggtcaactgaagaagtgggcaggcccgaggcaggagagatgctgaggagtccatgtg

SEQ ID NO: 2965 - DNA, 84 bp, Artificial Sequence
  Synthetic Oligonucleotide
gccgggaagaccgtaattgtggctgcactggatgggaccttccagaggaagccatttggggccatcctgaacctggtgccgctg

SEQ ID NO: 2966 - DNA, 73 bp, Artificial Sequence
  Synthetic Oligonucleotide
aagcagaagggagagcgtaagatcttccaggcacacaagaattgtgggcagatgagtgagattgaggccaagg

SEQ ID NO: 2967 - DNA, 68 bp, Artificial Sequence
  Synthetic Oligonucleotide
cagaaggatgcctgtggccctcggagagcacagtgtcaggcaacggaatcccagagccgcaggtctac

SEQ ID NO: 2968 - DNA, 68 bp, Artificial Sequence
  Synthetic Oligonucleotide
gaaatcgccagcttcgataaggccaagctgaagaaaacggagacgcaggaaaagaacaccctgccgac

SEQ ID NO: 2969 - DNA, 71 bp, Artificial Sequence
  Synthetic Oligonucleotide
cacatcaaagaactactgacaacgaaggccgcgcctgcctttcccatctgtctatctatctggctggcagg

SEQ ID NO: 2970 - DNA, 66 bp, Artificial Sequence
  Synthetic Oligonucleotide
agctcggaacctcaccgtgcctggcagccttcgggctgtggacataccgggcctcaaggctgctac

SEQ ID NO: 2971 - DNA, 69 bp, Artificial Sequence
  Synthetic Oligonucleotide
ggagaagggtgaccgactcagcgctgagatcaatcggcccgactatctcgactttgccgagtctgggca

SEQ ID NO: 2972 - DNA, 70 bp, Artificial Sequence
  Synthetic Oligonucleotide
tctcacctcgctatggttcgtctgcctctgcagtgcgtcctctggggctgcttgctgaccgctgtccatc

SEQ ID NO: 2973 - DNA, 71 bp, Artificial Sequence
  Synthetic Oligonucleotide
cctcagcaccagggtaccaggagctgaggagtgtgagcgtgccgtcatcgactttgtggctttccaggaca

SEQ ID NO: 2974 - DNA, 74 bp, Artificial Sequence
  Synthetic Oligonucleotide
cttcatcttccctctacccagattgtgaagatggaaagggtccaacccctggaagagaatgtgggaaatgcagc

SEQ ID NO: 2975 - DNA, 72 bp, Artificial Sequence
  Synthetic Oligonucleotide
aatccaagggggagagtgatgacttccatatggactttgactcagctgtggctcctcgggcaaaatctgtac

SEQ ID NO: 2976 - DNA, 66 bp, Artificial Sequence
  Synthetic Oligonucleotide
tgtggacatcttcccctcagacttccctactgagccaccttctctgccacgaaccggtcgggctag

SEQ ID NO: 2977 - DNA, 82 bp, Artificial Sequence
  Synthetic Oligonucleotide
ctatatgcagccagagatgtgacagccaccgtggacagcctgccactcatcacagcctccattctcagtaagaaactcgtgg

SEQ ID NO: 2978 - DNA, 74 bp, Artificial Sequence
  Synthetic Oligonucleotide
tgctgttgctgagtctgttgccagtccccagaagaccatgtctgtgttgagctgtatctgtgaagccaggcaag

SEQ ID NO: 2979 - DNA, 81 bp, Artificial Sequence
  Synthetic Oligonucleotide
gggccaaatattcagaagcttttatatcagaggaccaccatagcggccatggagaccatctctgtcccatcatacccatcc

SEQ ID NO: 2980 - DNA, 68 bp, Artificial Sequence
  Synthetic Oligonucleotide
gcggacttaatgcagagacaaggccagtatgacccacctccaggagccagcaacattttgggacttga

SEQ ID NO: 2981 - DNA, 66 bp, Artificial Sequence
  Synthetic Oligonucleotide
gacgctggtctggtgaagatgtccaggaaaccacgagcctccagcccattgtccaacaaccaccca

SEQ ID NO: 2982 - DNA, 73 bp, Artificial Sequence
  Synthetic Oligonucleotide
cttcacagtgctcctgcagtctctctgtgtggctgtaacttacgtgtactttaccaacgagctgaagcagatg

SEQ ID NO: 2983 - DNA, 65 bp, Artificial Sequence
  Synthetic Oligonucleotide
gcctcggtgtgcctttcaacatcgccagctacgccctgctcacgtacatgattgcgcacatcacg

SEQ ID NO: 2984 - DNA, 69 bp, Artificial Sequence
  Synthetic Oligonucleotide
ggagccggatgcagtaggactggactcgggccatatccgtggtgccgtcaacatgcctttcatggactt

SEQ ID NO: 2985 - DNA, 68 bp, Artificial Sequence
  Synthetic Oligonucleotide
tgtcaccccgactcaacgtgagacgcaccgcccggactcaccatgcgtgaatgcatctcagtccacgt

SEQ ID NO: 2986 - DNA, 73 bp, Artificial Sequence
  Synthetic Oligonucleotide
cgaggacgaggcttaaaaacttctcagatcaatcgtgcatccttagtgaacttctgttgtcctcaagcatggt

SEQ ID NO: 2987 - DNA, 67 bp, Artificial Sequence
  Synthetic Oligonucleotide
gtatcaccatcaatgcggctcatgtggagtatagcactgccgcccgccactacgcccacacagactg

SEQ ID NO: 2988 - DNA, 74 bp, Artificial Sequence
  Synthetic Oligonucleotide
tgtgtatagtcctgcccctcaaggtgtcacagtaagatgtcggataatccgggataaaaggggaatggatcggg

SEQ ID NO: 2989 - DNA, 68 bp, Artificial Sequence
  Synthetic Oligonucleotide
ggaggagctaaatgcctcaggccggtgcactctgcccattgatgagtccaacaccatccacttgaagg

SEQ ID NO: 2990 - DNA, 522 bp, Artificial Sequence
  Synthetic Oligonucleotide
gagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaagtggagcccagtgacaccatcgaaaatgtgaaggccaagatccaagataaagaaggcatccctcccgaccagcagaggctcatctttgcaggcaagcagctggaagatggccgcactctttctgactacaacatccagaaggagtcgaccctgcacctggtcctgcgcctgaggggtggctgttaattcttcagtcatggcattcgc

SEQ ID NO: 2991 - DNA, 67 bp, Artificial Sequence
  Synthetic Oligonucleotide
acgcaccctgtctgactacaacatccagaaagagtccaccctgcacctggtgctccgtcttagaggt

SEQ ID NO: 2992 - DNA, 67 bp, Artificial Sequence
  Synthetic Oligonucleotide
tgtctggcgataaagggatttctgccttccctgaatcagacaaccttttcaaatgggtagggaccat

SEQ ID NO: 2993 - DNA, 73 bp, Artificial Sequence
  Synthetic Oligonucleotide
ctccataatttatggcctgcagtatctcttcttggagcccaaccccgaggacccactgaacaaggaggccgca

SEQ ID NO: 2994 - DNA, 73 bp, Artificial Sequence
  Synthetic Oligonucleotide
gtgaagccaccgtcatcatgtctgaccaggaggcaaaaccttcaactgaggacttgggggataagaaggaagg

SEQ ID NO: 2995 - DNA, 70 bp, Artificial Sequence
  Synthetic Oligonucleotide
accatgctccagaaggaggggccccgagccttctacaaagggttcatgccctcctttctccgcttgggtt

SEQ ID NO: 2996 - DNA, 66 bp, Artificial Sequence
  Synthetic Oligonucleotide
ccatgcagcctggaatttgaggctacccagtgccccaacccattctcctacgtgcccaggcctctc

SEQ ID NO: 2997 - DNA, 71 bp, Artificial Sequence
  Synthetic Oligonucleotide
tgcggaaatgagctccaccggctccctggccactggggactacactagagcagcggttagaatggctgagg

SEQ ID NO: 2998 - DNA, 67 bp, Artificial Sequence
  Synthetic Oligonucleotide
gacagctgatccaggagccacgggtcctgcacttcaaggacagttaccacaacctgcgcctatccat

SEQ ID NO: 2999 - DNA, 68 bp, Artificial Sequence
  Synthetic Oligonucleotide
agaacggaggccgtgactgcagcgggacgctgctcgactctaagaactgcacagatgggctgtgcatg

SEQ ID NO: 3000 - DNA, 69 bp, Artificial Sequence
  Synthetic Oligonucleotide
ctgaacacagtggagctggtttgcaaactctgtgtgcggcaggtggaaggagaagggcagatcttccag

SEQ ID NO: 3001 - DNA, 70 bp, Artificial Sequence
  Synthetic Oligonucleotide
gtggatgtgccctgaaggacaagccaggcgtctacacgagagtctcacacttcttaccctggatccgcag

SEQ ID NO: 3002 - DNA, 79 bp, Artificial Sequence
  Synthetic Oligonucleotide
acgggtcctgcctcagttggcggaatggcggccacgggagccaatgcagagaaagctgaaagtcacaatgattgccccg

SEQ ID NO: 3003 - DNA, 89 bp, Artificial Sequence
  Synthetic Oligonucleotide
tggcttcaggagctgaataccctcccaggcacacacaggtgggacacaaataagggttttggaaccactattttctcatcacgacagca

SEQ ID NO: 3004 - DNA, 68 bp, Artificial Sequence
  Synthetic Oligonucleotide
gataccacaactcccatcaagctgttggcagtggcagccacggcgcctcctgatgcgcctaacaggga

SEQ ID NO: 3005 - DNA, 67 bp, Artificial Sequence
  Synthetic Oligonucleotide
ggctttggcagcttcagattcccttcagggaaccagggtggagctggccccagtcagggcagtggag

SEQ ID NO: 3006 - DNA, 71 bp, Artificial Sequence
  Synthetic Oligonucleotide
gctgcgacatggatttcgacattgctgggccttccatccggggtgctctggtgctaggttacgagggctgg

SEQ ID NO: 3007 - DNA, 66 bp, Artificial Sequence
  Synthetic Oligonucleotide
acccacggacagacttgcgcgcgtccaatgtgtattcctccatcatatgctgaccttggcaaagct

SEQ ID NO: 3008 - DNA, 67 bp, Artificial Sequence
  Synthetic Oligonucleotide
gccctggatttcagaaagagccaagtctggatctgggaccctttccttccttccctggcttgtaact

SEQ ID NO: 3009 - DNA, 71 bp, Artificial Sequence
  Synthetic Oligonucleotide
ctgctgtcttgggtgcattggagccttgccttgctgctctacctccaccatgccaagtggtcccaggctgc

SEQ ID NO: 3010 - DNA, 73 bp, Artificial Sequence
  Synthetic Oligonucleotide
tgtgaatgcagaccaaagaaagatagagcaagacaagaaaatccctgtgggccttgctcagagcggagaaagc

SEQ ID NO: 3011 - DNA, 77 bp, Artificial Sequence
  Synthetic Oligonucleotide
agcttcctacagcacaacaaatgtgaatgcagaccaaagaaagatagagcaagacaagaaaaatgtgacaagccgag

SEQ ID NO: 3012 - DNA, 71 bp, Artificial Sequence
  Synthetic Oligonucleotide
tgacgatggcctggagtgtgtgcccactgggcagcaccaagtccggatgcagatcctcatgatccggtacc

SEQ ID NO: 3013 - DNA, 83 bp, Artificial Sequence
  Synthetic Oligonucleotide
cctcagcaagacgttatttgaaattacagtgcctctctctcaaggccccaaaccagtaacaatcagttttgccaatcacactt

SEQ ID NO: 3014 - DNA, 72 bp, Artificial Sequence
  Synthetic Oligonucleotide
tgcccttaaaggaaccaatgagtccctggaacgccagatgcgtgaaatggaagagaactttgccgttgaagc

SEQ ID NO: 3015 - DNA, 67 bp, Artificial Sequence
  Synthetic Oligonucleotide
tacaagctgagtgcccaggcgggtgccgaaatggaggcttttgtaatgaaagacgcatctgcgagtg

SEQ ID NO: 3016 - DNA, 75 bp, Artificial Sequence
  Synthetic Oligonucleotide
agaggcatccatgaacttcacacttgcgggctgcatcagcacacgctcctatcaacccaagtactgtggagtttg

SEQ ID NO: 3017 - DNA, 74 bp, Artificial Sequence
  Synthetic Oligonucleotide
acaaagctaccagggagtcggcctttgtccacgccattgcctcagccggtgtggcctttgcagtgacacgctca

SEQ ID NO: 3018 - DNA, 75 bp, Artificial Sequence
  Synthetic Oligonucleotide
gtatcaggaccacatgcagtacatcggagaaggcgcgaagacaggcatcaaagaatgccagtatcaattccgaca

SEQ ID NO: 3019 - DNA, 79 bp, Artificial Sequence
  Synthetic Oligonucleotide
tgtcttcagggtcttgtccagaatgtagatgggttccgtaagaggcctggtgctctcttactctttcatccacgtgcac

SEQ ID NO: 3020 - DNA, 67 bp, Artificial Sequence
  Synthetic Oligonucleotide
cggtggaatctggctctggctccctctgctcttgacctggctcacccccgaggtcaactcttcatgg

SEQ ID NO: 3021 - DNA, 74 bp, Artificial Sequence
  Synthetic Oligonucleotide
atcgcagctggtgggtgtacacactgctgtttaccttggcgaggcctttcaccaagtccatgcaacagggagct

SEQ ID NO: 3022 - DNA, 76 bp, Artificial Sequence
  Synthetic Oligonucleotide
gggtagagggaaaagggttcaacaaaggctgaactggattcttaaccaagaaacaaataatagcaatggtggtgca

SEQ ID NO: 3023 - DNA, 73 bp, Artificial Sequence
  Synthetic Oligonucleotide
gatacatcgtctgcgaggaattcaaagacgtgctcctgactgcctgggaaaatgagcaggcagtcattgaaag

SEQ ID NO: 3024 - DNA, 70 bp, Artificial Sequence
  Synthetic Oligonucleotide
ggagatgaagcccccaagcttcctcagaagcaaccccagaccaaaaccaagcccactcaggcagctggac

SEQ ID NO: 3025 - DNA, 76 bp, Artificial Sequence
  Synthetic Oligonucleotide
agactgtggagtttgatgttgttgaaggagaaaagggtgcggaggcagcaaatgttacaggtcctggtggtgttcc

SEQ ID NO: 3026 - DNA, 68 bp, Artificial Sequence
  Synthetic Oligonucleotide
catggcctccgctatgaaggcggtgacagagctgaatgaacctctctccaatgaagatcgaaatctcc

SEQ ID NO: 3027 - DNA, 66 bp, Artificial Sequence
  Synthetic Oligonucleotide
ctgcgttcacaccccagtgtcacagggcgagctgttctggagagaaaaccatctgtcgtggctgag

SEQ ID NO: 3028 - DNA, 72 bp, Artificial Sequence
  Synthetic Oligonucleotide
tgctgagcctcctctccttggcaggggcactgtgatgaggagtaagaactcccttatcactaacccccatcc

What is claimed:

1. A method of predicting a likelihood that a human patient diagnosed with colorectal cancer will exhibit a positive clinical response to treatment with chemotherapy, comprising:
determining a level of an RNA transcript of HSPE1, or an expression product thereof, in a tumor sample obtained from said patient,
using the level of the RNA transcript of HSPE1, or an expression product thereof, to calculate a likelihood of a positive clinical response to chemotherapy, wherein increased level of the RNA transcript of HSPE1, or an expression product thereof, is positively correlated with an increased likelihood of a positive response to chemotherapy.

2. The method of claim 1 wherein said method is a PCR-based method.

3. The method of claim 1 wherein said method is an array-based method.

4. The method of claim 1, wherein said level is normalized relative to the expression levels of one or more reference genes, or their expression products.

5. The method of claim 1, wherein the colorectal cancer is Dukes B (stage II) or Dukes C (stage III) colorectal cancer.

6. The method of claim 1, wherein said colorectal cancer is colon cancer.

7. The method of claim 6, wherein said colon cancer is Duke B (stage II) or Dukes C (stage III) colon cancer.

8. The method of claim 1 wherein the chemotherapy is a 5-fluorouracil (5-FU) therapy.

9. The method of claim 1, further comprising determining a level of an RNA transcript, or an expression product thereof, of one or more genes selected from AURKB, Axin 2, BRAF, BRCA2, BUB1, C20orf1, CASP9, CDC2, CENPA, CENPF, CLIC1, CYR61, Cdx2, Chk1, DLC1, DUSP1, E2F1, ESPL1, FBXO5, FGF2, FOS, GSK3B, Grb10, HES6, HNRPAB, HOXB13, KIF22, MSH2, MSH3, NR4A1, PRDX2, RAD54L, RANBP2, ROCK2, RhoB, S100P, SAT, SOD1, STK15, TCF-1, TOP2A, TP53BP1, UBE2C, and VCP, wherein increased level the RNA transcript, or an expression product thereof, of the one or more genes is positively correlated with an increased likelihood of a positive response to chemotherapy.

10. The method of claim 1, further comprising determining a level of an RNA transcript, or an expression product thereof, of one or more genes selected from ABCB1, AMFR, ANXA1, APC, B-Catenin, CALD1, CD68, CDH11, CHFR, CLTC, COL1A1, COL1A2, CREBBP, CTSB, CTSL, EFNB2, EPAS1, FPGS, FZD1, GPX1, HIF1A, HNRPD, HSD17B2, IGFBP3, IGFBP7, IL6ST, ITGA5, KLF5, LEF, MADH7, MCM3, MCP1, MMP1, MMP2, Maspin, NRP1, PDGFC, PDGFRa, PFN2, PKR2, RUNX1, SEMA4B, SKP2, SPARC, TIMP1, UPP1, and VDAC2, wherein increased level of the RNA transcript, or an expression product thereof, of the one or more genes is negatively correlated with a likelihood of a positive response to chemotherapy.

11. The method of claim 1, wherein the clinical response is expressed in terms of Recurrence-Free Interval (RFI), Overall Survival (OS), Disease-Free Survival (DFS), or Distant Recurrence-Free Interval (DRFI).

12. The method of claim 1, further comprising generating a report based on the likelihood of a positive clinical response to chemotherapy.

13. The method of claim 1, wherein the tumor sample is a fixed, paraffin-embedded, fresh, or frozen tissue sample.

* * * * *

UNITED STATES PATENT AND TRADEMARK OFFICE
CERTIFICATE OF CORRECTION

| | | |
|---|---|---|
| PATENT NO. | : 8,067,178 B2 | Page 1 of 1 |
| APPLICATION NO. | : 12/404268 | |
| DATED | : November 29, 2011 | |
| INVENTOR(S) | : Baker et al. | |

It is certified that error appears in the above-identified patent and that said Letters Patent is hereby corrected as shown below:

On the Title page of the patent, please correct Item (75) the name of inventor Kim Langone to --Kim Clark-Langone--

Signed and Sealed this
Twenty-seventh Day of March, 2012

David J. Kappos
*Director of the United States Patent and Trademark Office*